United States Patent
Contreras et al.

(10) Patent No.: US 7,101,990 B2
(45) Date of Patent: Sep. 5, 2006

(54) BAX-RESPONSIVE GENES FOR DRUG TARGET IDENTIFICATION IN YEAST AND FUNGI

(75) Inventors: Roland Henri Contreras, Schelderode/Merelbeke (BE); Ines Eberhardt, Zwalm (BE); Walter Herman Maria Luyten, Turnhout (BE); Rieka Josephina Reekmans, Zwijnaarde (BE)

(73) Assignee: Janssen Pharmaceutica N.V., Beerse (BE)

( * ) Notice: Subject to any disclaimer, the term of this patent is extended or adjusted under 35 U.S.C. 154(b) by 359 days.

(21) Appl. No.: 10/451,467

(22) PCT Filed: Dec. 21, 2001

(86) PCT No.: PCT/EP01/15398

§ 371 (c)(1),
(2), (4) Date: Jun. 19, 2003

(87) PCT Pub. No.: WO02/064766

PCT Pub. Date: Aug. 22, 2002

(65) Prior Publication Data

US 2004/0161840 A1 Aug. 19, 2004

(30) Foreign Application Priority Data

| Dec. 22, 2000 | (EP) | 00870318 |
| Jan. 4, 2001 | (EP) | 01870002 |
| Jan. 9, 2001 | (EP) | 01870003 |

(51) Int. Cl.
*C07H 21/04* (2006.01)

(52) U.S. Cl. ............. 536/23.7; 536/24.1; 536/23.1; 435/320.1; 435/69.1; 435/254.2; 435/243; 435/252.3

(58) Field of Classification Search ............. 536/23.1, 536/23.7, 24.1; 435/320.1, 69.1, 254.2, 243, 435/252.3
See application file for complete search history.

(56) References Cited

FOREIGN PATENT DOCUMENTS

| GB | 2326413 | 12/1998 |
| WO | WO 9505750 | 3/1995 |
| WO | WO 9916787 | 4/1999 |
| WO | WO 9932514 | 7/1999 |
| WO | WO 0023083 | 4/2000 |
| WO | WO 0102550 | 1/2001 |

OTHER PUBLICATIONS

Ligr, M. et al. "Mammatian Bax triggers apoptotic changes in yeast". Federation of Biochemical Societies (FEBS) Letters 438 (1998) pp. 61–65. XP–000857722.

Marzo, I. et al. "Bax and Adenhe Nucleotide Translocaton Cooperate in the Mitochondrial Control of Apoptosis". SCIENCE vol. 281, Sep. 25, 1998, pp. 2027–2031, XP–000982449.

Tao, W. et al. "Modulation of Cell Death in Yeast by the Bci–2 Family of Proteins". Journal of Biological Chemistry 1997, vol. 272, Issue of Jun. 13, pp. 15547–15552, XP–000982450.

Greenhalf, W. et al. "A Secletion System for Human Apoptosis Inhibitors Using Yeast". Oncology Research, Novartis Pharma AG, Basel, Switzerland. Yeast 15 (1999), pp. 1307–1321. XP–002174101.

Brown, A. et al. "Codon utilsation in the pathogenic yeast, Candida albicans". Nucleic Acids Research, vol. 19, No. 15, Submitted May 28, 1991. p. 4298. Oxford University Press. XP–00100538. (Abstract).

Matsuyama, S. et al. "The Mitochondrial FOF1–ATPase Proton Pump Is Required for Function of the Prospoptotic Protein Bax in Yeast and Mammalian Cells". Molecular Cell, vol. 1, pp. 327–336, Feb. 1998, XP–000987219.

Martinet, W. et al. "Bax–induced cell death in Pichia pastoris" Biotechnology Letters 21: pp. 821–829, 1999. XP–001106921.

Frohlich, K. et al. "Apoptosis in yeast—a monocellular organism exhibits atrulstic behaviour" FEBS Letters 473 (2000) pp. 6–9.

Oitvai, Z. et al. "Bci–2 Heterodimertzes in Vivo with a Conserved Homolog, Bax, That Accelerates Programmed Cell Death" Cell, vol. 74, pp. 609–619, Aug. 27, 1993. XP–002018918.

Torgler, C.N. et al. "Exploiting the utility of yeast in the context of programmed cell death". Medthe Methods Enzymol 2000, 297–322, XP–002174102. (Abstract).

Xu, Q. et al. "Methods of Assaying Bci–2 and Bax Family Proteins in Yeast". A Companion to Methods in Enzymology 17, pp. 292–304 (1999).

*Primary Examiner*—Jennifer E. Graser
(74) *Attorney, Agent, or Firm*—Laura Donnelly

(57) ABSTRACT

The use of nucleic acids and polypeptides which are involved in a pathway eventually leading to programmed cell death of yeast or fungi for the preparation of a medicament for treating diseases associated with yeast or fungi or for the treatment of prolifeative disorders or for preventing apoptosis in certain diseases is disclosed. Methods are provided to identify compounds which selectively modulate the expression or functionality of said polypeptides in the same or a parallel pathway. Also provided are compounds as well as pharmaceutical compositions, medicaments and vaccines. New nucleic acid sequences, probes and primers derived thereof, expression vectors and host cells transformed with said vectors, polypeptides and antibodies raised against said polypeptides are also disclosed.

13 Claims, 251 Drawing Sheets

Figures 1, 3:
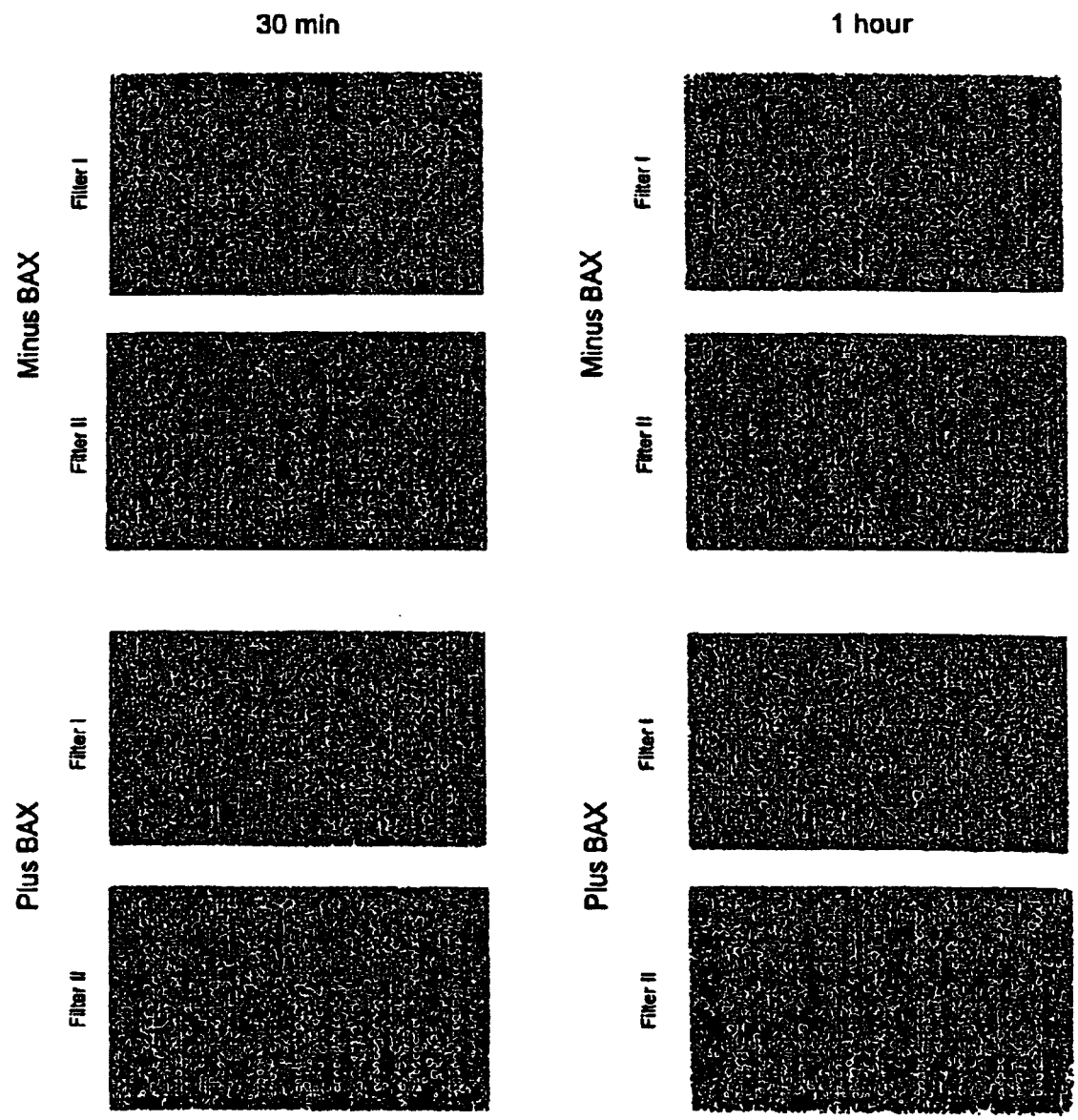

Figure 1:

YBL002W, 896 bp, CDS: 501-896 (SEQ ID NO 21)
TGTTTGATATTAGTAGTCATGTTGTAATCTCTGGCCTAAGTATACGTAACGAAAATGGTA
GCACGTCGCGTTTATGGCCCCAGGTTAATGTGTTCTCTGAAATTCGCATCACTTTGAGA
AATAATGGGAACACCTTACGCGTGAGCTGTGCCCACCGCTTCGCCTAATAAAGCGGTGTT
CTCAAAATTTCTCCCCGTTTTCAGGATCACGAGCGCCATCTAGTTCTGGTAAAATCGCGC
TTACAAGAACAAAGAAAAGAAACATCGCGTAATGCAACAGTGAGACACTTGCCGTCATAT
ATAAGGTTTTGGATCAGTAACCGTTATTTGAGCATAACACAGGTTTTTAAATATATTATT
ATATATCATGGTATATGTGTAAAATTTTTTGCTGACTGGTTTTGTTTATTTATTTAGCT
TTTTAAAAATTTTACTTTCTTCTTGTTAATTTTTTCTGATTGCTCTATACTCAAACCAAC
AACAACTTACTCTACAACTAATGTCCTCTGCCGCCGAAAAGAAACCAGCTTCCAAAGCTC
CAGCTGAAAAGAAGCCAGCTGCCAAGAAAACATCAACCTCCGTCGATGGTAAGAAGAGAT
CTAAGGTTAGAAAGGAGACCTATTCCTCTTATATTTACAAAGTTTTGAAGCAAACTCACC
CAGACACTGGTATTTCCCAGAAGTCTATGTCTATTTTGAACTCTTTCGTTAACGATATCT
TTGAAAGAATTGCTACTGAAGCTTCTAAATTGGCCGCTTATAACAAGAAATCCACTATTT
CTGCTAGAGAAATCCAAACAGCCGTTAGATTGATCTTACCTGGTGAATTGGCTAAACATG
CCGTCTCCGAAGGTACTAGGGCTGTTACCAAATACTCCTCCTCTACTCAAGCCTAA

YBL002W, 131 aa (SEQ ID NO 22)
MSSAAEKKPASKAPAEKKPAAKKTSTSVDGKKRSKVRKETYSSYIYKVLKQTHPDTGISQ
KSMSILNSFVNDIFERIATEASKLAAYNKKSTISAREIQTAVRLILPGELAKHAVSEGTR
AVTKYSSSTQA

YBL064C, 1286 bp, CDS: 501-1286 (SEQ ID NO 25)
TTGCCAACCTCAAAGAAGAAGAATTATGGGCATATTGACCTTCTCCGGTTTCCCTCCCGC
GCTCTCGTATCCGTCTGCATTTGACCTCGAGCAAGCGCTCCACTATGTCTATATGTTTAC
CAGTAAAACTTCTTAACGTTTGTGATATTTTTGAACTTCAACCACATTCAGTATGCGTG
TGTATATAAAGATATTCCTGATAGCACTATGTTTATCTTTATACAATATACAAAAGGTCA
CCCAGGACGAGCAGCGCGGCTATTTTTCTATCATTCCGTGAATAGCGACCAACGGTCGGC
GGCTATTTTTTTTTTGCAATTTTTTCGGGATGGGTTCCCCGGCAAAAGCTAGCCCCGGA
GATTTTTAATTACGTAAAGAAACAAGGGGCCGGATGTTGCTGCTATTGGTATATAAAGAG
AGAAGGAGAGATATAGAAAATTGTGCTTCTAGATTCTCGCAGTAGGATGAGATAAATTTC
AAAGAAGCAGGAAGCAAAGGATGTTTAGTAGAATTTGTAGCGCTCAATTAAAGAGGACGG
CATGGACCCTTCCTAAGCAGGCTCACTTGCAATCACAGACGATTAAAACATTTGCCACAG
CACCTATTCTGTGCAAACAATTCAAACAAAGTGATCAACCAAGACTAAGAATAAACTCTG
ATGCTCCTAACTTTGATGCTGACACAACGGTTGGTAAAATCAATTTTTACGACTACTTGG
GCGACTCTTGGGGGGTCTTGTTTTCTCACCCAGCAGATTTCACCCCTGTCTGCACCACCG
AAGTCAGCGCATTCGCCAAATTGAAGCCGGAATTCGACAAGAGAAATGTTAAATTGATCG
GGCTTTCAGTGGAAGATGTTGAGTCCCACGAAAAATGGATTCAAGACATCAAGGAAATAG
CAAAGGTTAAAAATGTTGGTTTCCCAATAATTGGTGACACTTTTAGAAACGTGGCATTCC
TATATGATATGGTAGATGCCGAAGGATTCAAAAATATCAATGATGGGTCACTGAAGACCG
TGAGGTCTGTTTTCGTCATCGATCCCAAGAAGAAGATTAGACTGATTTTTACCTACCCTT
CCACCGTCGGAAGAAACACTTCTGAAGTGTTAAGGGTAATCGACGCCTTGCAATTGACTG
ACAAGGAGGGCGTAGTAACTCCAATTAATTGGCAGCCAGCTGACGATGTCATTATTCCTC
CCTCTGTCTCCAATGATGAGGCGAAGGCTAAATTTGGTCAATTTAATGAAATTAAACCCT
ATTTAAGATTCACCAAGTCGAAATAA

YBL064C, 261 aa (SEQ ID NO 26)
MFSRICSAQLKRTAWTLPKQAHLSQTIKTFATAPILCKQFKQSDQPRLRINSDAPNFDA
DTTVGKINFYDYLGDSWGVLFSHPADFTPVCTTEVSAFAKLKPEFDKRNVKLIGLSVEDV
ESHEKWIQDIKEIAKVKNVGFPIIGDTFRNVAFLYDMVDAEGFKNINDGSLKTVRSVFVI
DPKKKIRLIFTYPSTVGRNTSEVLRVIDALQLTDKEGVVTPINWQPADDVIIPPSVSNDE
AKAKFGQFNEIKPYLRFTKSK

YBR089C-A, 800 bp, CDS: 501-800 (SEQ ID NO 47)
TTTTTTAGGTGGCGCGGCAACTATAAAGTACAGCAAGTGAGGTTGAGGCAATACTGGGAG
TTTACACTATGGGAGACAGCTCCTAACACCAAGCAGAAAAACGACTTTTTCGCAAAGTAT
GTAAGGCGCTGGGTGAGCCCAGCGGACGAGGATGGGCTTAATAAGAACGTACAGTTTAGC
ACAGCTAGAACAGGATACAGCTAAGGGCAACTCTGCTTTTCGGGAGAAGTTAAAGAGGGG
TAGACAATGATGGTAATCTTATAAACCGGCTACAATGAAGGTTGTAGCAGCAAGGAAGAT
GATATTTTAATACGGTTCAGGTGAAATGAAATAGCCGCCCATAACGGCATGCTCAAGTTG
TAAGTCAGGACTCTAGCTTTCTACTGTAGTATCCTCTAAAGGACTGCTGTTCTGTGCACC
CCCTTCCTTTGTTTATCATAGCGCACGACAAGAGTACTAACTAATTAACTTAGAACATTA
ACATATATAAAACTAGCGCTATGGCCGCAACTAAAGAAGCAAAGCAACCAAAGGAACCAA
AGAAGAGGACCACCAGGAGAAAGAAGGATCCTAACGCCCCTAAGAGGCGGTTGTCAGCTT
ATATGTTCTTTGCTAATGAAAACAGAGACATTGTCCGTTCCGAGAATCCTGACGTAACTT
TTGGCCAAGTAGGCAGAATATTGGGTGAGAGGTGGAAGGCCTTAACTGCTGAAGAAAGC
AACCCTATGAATCTAAGGCTCAAGCAGACAAGAAGAGATACGAATCTGAAAAGGAATTGT
ACAATGCTACACGTGCTTGA

YBR089C-A, 99 aa (SEQ ID NO 48)
MAATKEAKQPKEPKKRTTRRKKDPNAPKRRLSAYMFFANENRDIVRSENPDVTFGQVGRI
LGERWKALTAEEKQPYESKAQADKKRYESEKELYNATRA

YBR149W, 1535 bp, CDS: 501-1535 (SEQ ID NO 57)
TTCGCAAACATCAACTTCTCCTTAATCGACCAACTGACAATGAACTTCAGGTTCTACGAG
AGATCTGCCAATTTCCAGAAGGAAACAATAGGTGGGTTAAGAATGATGCTACAAGATAAG
GATAACTATATCAAAACACTGATGCAACATTTGAAGAAAAAGAGAGTACAAAGTTGATA
AAAGACAGCAAGAATGGCGCCTCCACCTTAACATCTTAACAATTTCGTTTACTGAAAATG
CTACTAGTATATAATCATTAAGTATCTAACTATCACTCAATAAAAATATTATAGATCGCT
TAAAAACTCGTTTATTGCCGATTATAAATCCACCAAAAGCCGCTCTACCCTTACCTCCGC
CTGGAAAAATTATAATATATAAAGTGAGCCTCGTAATACAGGGGTAAAAAGGAAAGAGGG
GGATATCAAGCATCTGGACTTATTTGCACTATCTCCGCCTTCAATTGATAAAAGCGTCTT
GATTTAATCAACTGCTATCATGTCTTCTTCAGTAGCCTCAACCGAAAACATAGTCGAAA
ATATGTTGCATCCAAAGACTACAGAAATATACTTTTCACTCAACAATGGTGTTCGTATCC
CAGCACTGGGTTTGGGGACAGCAAATCCTCACGAAAGTTAGCTGAAACAAAACAAGCCG
TAAAAGCTGCAATCAAAGCTGGATACAGGCACATTGATACTGCTTGGGCCTACGAGACAG
AGCCATTCGTAGGTGAAGCCATCAAGGAGTTATTAGAAGATGGATCTATCAAAAGGGAGG
ATCTTTTCATAACCACAAAAGTGTGGCCGGTTCTATGGGACGAAGTGGACAGATCATTGA
ATGAATCTTTGAAAGCTTTAGGCTTGGAATACGTCGACTTGCTCTTGCAACATTGGCCGC
TATGTTTTGAAAAGATTAAGGACCCTAAGGGGATCAGCGGACTGGTGAAGACTCCGGTTG
ATGATTCTGGAAAAACAATGTATGCTGCCGACGGTGACTATTTAGAAACTTACAAGCAAT
TGGAAAAATTTACCTTGATCCTAACGATCATCGTGTGAGAGCCATTGGTGTCTCAAATT
TTTCCATTGAGTATTTGGAACGTCTCATTAAGGAATGCAGAGTTAAGCCAACGGTGAACC
AAGTGGAAACTCACCCTCACTTACCACAAATGGAACTAAGAAAGTTCTGCTTTATGCACG
ACATTCTGTTAACAGCATACTCACCATTAGGTTCCCATGGCGCACCAAACTTGAAAATCC
CACTAGTGAAAAAGCTTGCCGAAAAGTACAATGTCACAGGAAATGACTTGCTAATTTCTT
ACCATATTAGACAAGGCACTATCGTAATTCCGAGATCCTTGAATCCAGTTAGGATTTCCT
CGAGTATTGAATTCGCATCTTTGACAAAGGATGAATTACAAGAGTTGAACGACTTCGGTG
AAAAATACCCAGTGAGATTCATCGATGAGCCATTTGCAGCCATCCTTCCAGAGTTTACTG
GTAACGGACCAAACTTGGACAATTTAAAGTATTAA

YBR149W, 344 aa (SEQ ID NO 58)
MSSSVASTENIVENMLHPKTTEIYFSLNNGVRIPALGLGTANPHEKLAETKQAVKAAIKA
GYRHIDTAWAYETEPFVGEAIKELLEDGSIKREDLFITTKVWPVLWDEVDRSLNESLKAL
GLEYVDLLLQHWPLCFEKIKDPKGISGLVKTPVDDSGKTMYAADGDYLETYKQLEKIYLD
PNDHRVRAIGVSNFSIEYLERLIKECRVKPTVNQVETHPHLPQMELRKFCFMHDILLTAY
SPLGSHGAPNLKIPLVKKLAEKYNVTGNDLLISYHIRQGTIVIPRSLNPVRISSSIEFAS
LTKDELQELNDFGEKYPVRFIDEPFAAILPEFTGNGPNLDNLKY

YBR289W, 3218 bp, CDS: 501-3218 (SEQ ID NO 63)
GATACGATCTATAGTCTCTAAAAAGGTAAAACAATCAAGCGGGCCTTTTGACTTCGAAGT
GGAGGCTAAGCACCAATAATTGAGCTTATTTATAACTGAGAAATACTTATAGACCTCTAA
ATCTCTTCCAACCATTGAATGGTCTAAATAATCATCACTACTGCTATCTTCGAGCAATTG
AGGACATGTGGTACGAACGCGGGTCCACAGGTGCTTGAAGGAGGGAGCTGTTGCACCTAA
AAGATACTGGAAAATAAGTTTGTTCTTTGTATCAGTGATATAGAATGACAAATACATCTA
TTTTGGTTGGGTTGGTAAGGTTTACAGCCTCTGTTGTTGCCCAAGTCCTGTTATCGCCAA
CTTTAAATAAATCTCTTCTTGTTCTTTGACCAAAAATTTCATTTTTCGTCGCATTTAAAA
GAAACTGAAATTTCAAACATAAACACCAAAACAAAGCATCATCAAGGGAACATATAGTAA
AGAACTACACAAAAGCAACAATGAATAATCAGCCGCAGGGTACCAACAGCGTTCCAAATA
GTATTGGAAATATATTTAGCAACATTGGAACTCCATCTTTTAACATGGCGCAAATTCCGC
AACAGCTGTATCAGAGCCTCACACCACAACAATTGCAGATGATTCAGCAACGACACCAAC
AGTTACTGAGGAGTCGTCTACAACAACAACAACAACAACAACAACAAACTTCACCGCCAC
CGCAAACGCATCAATCTCCACCCCCTCCTCCGCAACAATCTCAACCCATTGCTAATCAAT
CAGCGACTTCTACCCCTCCTCCTCCTCCAGCACCACACAACTTACATCCCCAAATTGGTC
AAGTGCCCTTAGCTCCAGCGCCTATTAATTTGCCTCCACAAATTGCTCAGTTACCTTTGG
CTACACAGCAACAAGTTTTGAACAAGTTGAGGCAGCAGGCCATAGCAAAAAATAATCCAC
AGGTTGTGAATGCAATTACTGTTGCACAACAACAAGTGCAACGCCAAATTGAGCAGCAAA
AGGGACAGCAAACGGCACAAACTCAGCTAGAACAGCAGAGGCAATTGCTGGTTCAGCAGC
AACAGCAGCAGCAACTTAGAAACCAAATACAGCGACAACAGCAACAACAGTTTAGGCATC
ATGTGCAAATACAACAGCAGCAACAAAAGCAACAACAACAGCAGCAGCAGCATCAGCAAC
AACAACAACAACAACAGCAACAGCAGCAACAGCAACAGCAACAGCAGCAGCAACAACAAC
AGCAACAACAACAACAACAGCAGCAGCAGCAGCAGCAGCAGCAAGGACAAATACCGCAAT
CTCAGCAAGTTCCTCAAGTTAGATCCATGAGTGGACAACCTCCCACCAATGTTCAGCCCA
CTATTGGCCAACTTCCTCAACTTCCAAAATTAAACTTACCCAAGTACCAAACTATTCAAT
ACGATCCACCAGAAACCAAGCTACCATATCCAACCTATTGGTCAGACAAAAAAGCAGATA
CGGATACTTTGTTGTACGAACAAATTATCCAGCGTGATAAAATTAACAAATATTCGCTAA
TAAGAGAAACCAATGGTTACGATCCGTTTAGCATTTATGGATTTAGTAATAAAGAGTATA
TTAGTAGACTGTGGCATACACTGAAGTATTATCAAGATTTGAAGAACACTAGAATGAAAT
CTATCACAAGCACTTCTCAGAAGATTCCTTCGGCAAGTATTTGGGGAAATGGTTACTCAG
GGTATGGTAATGGGATTACGAATACAACTACCAGAGTTATTCCACAAGTAGAAGTTGGAA
ATAGGAAGCATTACCTAGAGGATAAATTAAAAGTCTATAAACAGGCCATGAATGAGACAT
CGGAACAGTTAGTTCCCATAAGATTGGAGTTCGATCAAGATCGTGACAGATTCTTCCTCA
GGGACACTTTGTTATGGAACAAAAATGACAAGCTTATTAAAATTGAAGACTTTGTGGACG
ACATGTTGCGAGATTACCGATTTGAGGACGCTACGAGAGAGCAACACATTGATACTATTT
GTCAATCTATACAAGAGCAGATTCAGGAGTTTCAAGGAAATCCATATATAGAGTTGAATC
AGGACCGTCTAGGCGGTGATGACTTGAGAATTAGAATCAAGCTGGATATTGTCGTGGGAC
AAAACCAGTTAATCGATCAATTTGAGTGGGAGATCTCTAATAGTGATAACTGTCCAGAAG
AGTTTGCAGAGTCCATGTGTCAAGAATTAGAACTACCAGGTGAGTTTGTGACTGCCATTG
CTCACTCCATAAGAGAGCAAGTTCATATGTATCATAAATCACTGGCACTGTTAGGTTACA
ATTTTGATGGATCAGCGATAGAAGATGATGACATTAGAAGCAGAATGCTCCCAACGATTA
CTCTTGATGATGTTTATAGGCCTGCAGCGGAAAGCAAAATTTTTACTCCAAACCTATTAC
AGATTTCAGCTGCAGAGTTAGAGAGATTGGATAAAGATAAGGACAGAGACACAAGAAGGA
AAAGAAGACAAGGTAGATCTAATAGACGTGGTATGCTCGCATTGTCCGGCACATCTGCAA
GTAATACATCTATGAACGGCGTTCACAACACAGTAGCAGCAGGAAATGCTTCATCGTTGC
CACCAGGAGAGATTTTACTGCCAGATATTGCAGATATTCCAAGAACTTTCAGGACTCCAG
TACCTAGCACTTTAATGCCTGGTGGTGTTGACGTAGGCCCTTCTGTGGAATCGTACGAAT
TGAGAAACACAACCACTTATAAAGCAGGCCAGATAGACCTAAGCCAGTTTCACCTCCTT
GTTATATTATTGACCATATTCCGGGTCATTCGCTACTACTTTCTATTAAACTGCCTGGGA
AAGTTAATACAAAAGAAGAGTTCGCAGCAGCGCCCAATGACACAAGTAGTGGCACCAATG
CAATGCTTCCGAGTCCAGAATCGCTGAAAACTAAGCTGAATAGTAACATTCGCGCTGGTG
TGACGATACCTTCAATCCCAAACCCGATTGCCAATCACACTGTTACTAATTCACCCAATC
CCACACTGCAGCCAGTAATCCCAGGTGGGGCAGCTAGTAAATCGGTACCTACACCTAGTC
TTCCTATAGCACCTCCAGTAGCACCACATGATAGCGAAGCGACATTGTTGACTAATAGCA
ATAATGGTAGCAGTAACAATAACACACAGAATACATAG

YBR289W, 905 aa (SEQ ID NO 64)
MNNQPQGTNSVPNSIGNIFSNIGTPSFNMAQIPQQLYQSLTPQQLQMIQQRHQQLLRSRL
QQQQQQQQQTSPPPQTHQSPPPPPQQSQPIANQSATSTPPPPPAPHNLHPQIGQVPLAPA
PINLPPQIAQLPLATQQQVLNKLRQQAIAKNNPQVVNAITVAQQQVQRQIEQQKGQQTAQ
TQLEQQRQLLVQQQQQQQLRNQIQRQQQQQFRHHVQIQQQQQKQQQQQQQHQQQQQQQQQ
QQQQQQQQQQQQQQQQQQQQQQQQQQQQGQIPQSQQVPQVRSMSGQPPTNVQPTIGQLPQ
LPKLNLPKYQTIQYDPPETKLPYPTYWSDKKADTDTLLYEQIIQRDKINKYSLIRETNGY
DPFSIYGFSNKEYISRLWHTLKYYQDLKNTRMKSITSTSQKIPSASIWGNGYSGYGNGIT
NTTTRVIPQVEVGNRKHYLEDKLKVYKQAMNETSEQLVPIRLEFDQDRDRFFLRDTLLWN
KNDKLIKIEDFVDDMLRDYRFEDATREQHIDTICQSIQEQIQEFQGNPYIELNQDRLGGD
DLRIRIKLDIVVGQNQLIDQFEWEISNSDNCPEEFAESMCQELELPGEFVTAIAHSIREQ
VHMYHKSLALLGYNFDGSAIEDDDIRSRMLPTITLDDVYRPAAESKIFTPNLLQISAAEL
ERLDKDKDRDTRRKRRQGRSNRRGMLALSGTSASNTSMNGVHNTVAAGNASSLPPGEILL
PDIADIPRTFRTPVPSTLMPGGVDVGPSVESYELRNTTTYKSRPDRPKPVSPPCYIIDHI
PGHSLLLSIKLPGKVNTKEEFAAAPNDTSSGTNAMLPSPESLKTKLNSNIRAGVTIPSIP
NPIANHTVTNSPNPTLQPVIPGGAASKSVPTPSLPIAPPVAPHDSEATLLTNSNNGSSNN
NTQNT

YCR004C, 1244 bp, CDS: 501-1244 (SEQ ID NO 69)
TTAAGAAAATGAACGTTACTATTTCCTTCCTCGTTTTAGTTACATAAAATTTACTAATGG
TTGGAAAATTGCGGAAGCTATCACGCGATAACTAGGTACACACGCATTATTTTTATAATC
CCATTATTAATAAATCCGTTATGACCCTTTTAGTAATAACTTATTAAGAACCTCCGGGTA
AAATACTGTACTGCGGGGAAAGAAGGCGCTTCCCCTTCTTGGAACTTAATATAAATAATA
AATTTGCCTAAGGGCATTAGGCCTTACTGCCTTGGCTAGCGTACTTATTTCGATTCATAC
AATTTGCACTATTCCGGCAGCTAGTTGATACTATAACATCCTACATTTTTACTTGTTTTA
CGTTCATTTTTATTTGAAGTTTGTAAACTTTATCAGAAAGAAAACAAGAAGAGGAAAAAG
GAAAAGAGGGGTCAGGTTAGTATCAATAAAAAAAAGAGAGTAAACAAAACAATACAGAC
TCAATTGAAGCACTATAAGAATGGTAAAGATTGCGATAATTACTTACTCTACCTACGGGC
ACATAGACGTTTTAGCCCAAGCTGTTAAGAAAGGTGTGGAGGCAGCTGGTGGTAAAGCTG
ATATATACAGGGTCGAGGAAACTTTACCTGATGAAGTCCTCACCAAGATGAACGCTCCTC
AGAAACCTGAAGATATTCCTGTTGCCACTGAGAAAACGTTGCTCGAATATGACGCCTTTT
TGTTCGGTGTTCCAACTAGGTTTGGTAATTTGCCGGCTCAATGGTCCGCCTTTTGGGATA
AAACCGGTGGATTATGGGCCAAGGGCTCTTTGAACGGCAAAGCTGCGGGGATATTCGTTA
GTACTTCCAGTTACGGAGGTGGTCAAGAAAGTACCGTTAAAGCCTGTTTGTCTTATTTAG
CTCATCACGGAATTATCTTTTTACCACTGGGTTATAAGAATTCATTTGCTGAGTTAGCCA
GTATAGAAGAGGTACACGGTGGCTCTCCATGGGGTGCTGGTACCCTTGCAGGACCTGACG
GCTCAAGAACTGCGTCTCCACTTGAATTGAGAATTGCTGAAATTCAAGGTAAAACATTCT
ACGAAACCGCCAAAAAACTTTTCCCTGCAAAAGAAGCCAAGCCCTCCACTGAAAAGAAGA
CCACTACTTCTGATGCGGCTAAGAGACAAACTAAACCTGCAGCAGCTACAACTGCAGAAA
AGAAGGAGGACAAAGGATTATTATCCTGCTGTACTGTCATGTAA

YCR004C, 247 aa (SEQ ID NO 70)
MVKIAIITYSTYGHIDVLAQAVKKGVEAAGGKADIYRVEETLPDEVLTKMNAPQKPEDIP
VATEKTLLEYDAFLFGVPTRFGNLPAQWSAFWDKTGGLWAKGSLNGKAAGIFVSTSSYGG
GQESTVKACLSYLAHHGIIFLPLGYKNSFAELASIEEVHGGSPWGAGTLAGPDGSRTASP
LELRIAEIQGKTFYETAKKLFPAKEAKPSTEKKTTTSDAAKRQTKPAAATTAEKKEDKGL
LSCCTVM

YCR013C, 1148bp, CDS: 501-1148 (SEQ ID NO 77)
TGAAAAATGATGAAGGCACATTGTTAATTGAAGAAGAAGAAGAAGAAACAAAATTAA
AACCGATTGACCAATATATGTCTCTGAATGCCAAGGATGGAAATTATTGCAGAAGATTAG
ACTTTTTTTGTTGCAAGTGGGATGAGCTTGGAGCAGGAAGAATACACTATACTGGATCTA
AAGAGTACAATAGATGGATAAGAATATTGGCAGCGCAAAAAGGCTTCAAGCTTACACAAC
ACGGTTTATTTCGAAATAATATCCTTCTCGAAAGCTTTAACGAACGCAGAATTTTCGAGT
TATTAAACTTAAAATACGCTGAACCCGAACATAGAAATATCGAATGGGAAAAAAAACTG
CATAAAGGCATTAAAAGAGGAGCGAATTTTTTTTTAATAAAAATCTTAATAATCATTAAA

AGATAAATAATAGTCTATATATACGTATATAAATAAAAAATATTCAAAAAATAAAATAAA
CTATTATTTTAGCGTAAAGGATGGGGAAAGAGAAAAGAAAAAAATTGATCTATCGATTTC
AATTCAATTCAATTTATTTCTTTTCGGATAAGAAAGCAACACCTGGCAATTCCTTACCTT
CCAATAATTCCAAAGAAGCACCACCACCAGTAGAGACATGGGAGATCTTGTCAGTGACAC
CGTACTTCTTAGCGACAGTGGCAGTGTCACCACCACCAATGATGACGGTGTTACCAGCAG
CAGAGCTCTTGACAACTTCGTCTAACAAAGCCTTAGTACCAGCAGCGAACTTTTCGAATT
CGAAAACACCTGGTGGACCGTTCCAGACAATGGTCTTAGCCTTTGCAACAGTAGCAGCAA
ACAACTTTCTAGATTCTGGACCATTGTCCAACCCTTGCCAGCCAGCTGGAATACCTTCCT
TGTCAGTGACAGTCTTGGTGTTGGCATCAGCAGAGAAGCATCAGCAATGATGAAGTCGA
CTGGCAAGACGACTTCGACACCCTTGGCCTTGGCCTTTTCCATCAACTTTGGAACGATTT
CAGCACCAGCCTTGTCGAAGATGGAGTCACCGATTTCAGTGTTTTCCAAAACCTTCTTGA
AGGTGAAAGCCATACCACCACCAATGATGATAGAGTCGACCTTGTCCAACAAGTTGTCAA
TCAATTGA

YCR013C, 215 aa (SEQ ID NO 78)
MGKEKRKKLIYRFQFNSIYFFSDKKATPGNSLPSNNSKEAPPPVETWEILSVTPYFLATV
AVSPPPMMTVLPAAELLTTSSNKALVPAANFSNSKTPGGPFQTMVLAFATVAANNFLDSG
PLSNPCQPAGIPSLSVTVLVLASAEKASAMMKSTGKTTSTPLALAFSINFGTISAPALSK
MESPISVFSKTFLKVKAIPPPMMIESTLSNKLSIN

YDL059C, 1217 bp, CDS: 501-1217 (SEQ ID NO 83)
AAAGTATCAAGTTCGCTAAATTTACTTCGAAGACAGAAGCCAGTAAATTTTGTTTTCTTC
ATGGAAATAGTTTCCAAAAAGTTCTTAGTAATTACCATATGTTCTTGTATGTGGCGCTGC
GAAAGAAAGGTTAGCCGACCGGCATCACCCATAATTGTATAATATAGCAATGAAGCAACT
TGTTGAAGTTTTCTTTAAAGTACTATAGTATTGAATAATATCATGTTCACTTGATAAAAT
TGGGTATTTTATTGACCATTATATCGCGTTGGACACTAATGTCTTTCAAGTTGGTGTCAC
GTCACGTGCTTTTCAATGTACTGGGGCAAATTGATTAGAGGAAGCCACAGTTTGGCAAGG
GCAGATATGATAGGAAGCAGTAACGGCAAGGAAGGATAAGAACATCATTGAGGGAGTCTG
TGGCAGTTTAGCACATGCTTTGGACCATTAAAGGGTTACGTAGAGGAGAAGAGCATATTT
CAGGATAAACAGACAAAATAATGACGATACAAGCGAAGCCCAGTTCGAGCATATCGTATG
ATTCGACTACATACGGCACAGCACCGGGCTTGGATATAAAAGAGTTCCAAATCATCGAAG
ATTGGAATGGAAGACCTGCCAGCGCTTGGTCGGTGCAGAGGATTGGGCTTCTACAGTCCA
AGATGGAAAGGTACACGTACAATATTTACCACAATAATAAATATGGGAAGCACAACTTAT
CTAAGCTGATACCAGGGCATGCTCTCATTCAGTTCGCTAATGAAACATTCGGGTATGATG
GTTGGCGAATGGATGTTATAGATGTTGAGGCCCGGGAGTGCCAGCCCTTCACCGCAGTAA
ATAATGGAGAAAACACCAACACTAGTGAGGTCAAGTATACAGTTGTGGCAGAAGCCCAAG
TAAAGGTTACCTTAAAGGATGGCACCAACACACAGTGTGGTGGGCTAGGTAGAATTACTT
TGTCCTCGAGAGGTGAATGTTATAACAGGTCGAAAAAAGAGGCTGTAGGCGATGCGTTAA
AGAAGGCGTTATTGAGCTTTGAAAAAATCATACTCGATTATGAGACTAAGATTACAAATA
ATTACTATGTCGATGGCTTGTATGGCTCAAAAAAAATTAAAAATGAAGCTAACACCAATT
ACAACTTATTGTCAGCGACTAATAGCAAGCCGACTTTTATCAAATTGGAGGATGCTAAAG
GCACGCATATCAAATAA

YDL059C, 238 aa (SEQ ID NO 84)
MTIQAKPSSSISYDSTTYGTAPGLDIKEFQIIEDWNGRPASAWSVQRIGLLQSKIERYTY
NIYHNNKYGKHNLSKLIPGHALIQFANETFGYDGWRMDVIDVEARECQPFTAVNNGENTN
TSEVKYTVVAEAQVKVTLKDGTNTQCGGLGRITLSSRGECYNRSKKEAVGDALKKALLSF
EKIILDYETKITNNYYVDGLYGSKKIKNEANTNYNLLSATNSKPTFIKLEDAKGTHIK

YDL147W, 1838 bp, CDS: 501-1838 (SEQ ID NO 87)
ACTCTTCTCTGATTTCAGCAATGGCCTTTTTTTTTTCTTCACGATCATACTCCTTCGCTT
GTCTTTTGGAATTCTTTTTATTCTTACTTTTGACGTTTGTTTGACCTGTGAGTCCACGGG
CCTTCAAGGCGGCCTTTAAATTCTTAAGTTGTGAACCGGCCATGTATTTGATCTTCCCTT
TTATTTGCTTCTCAACTGTACTATTTACAGTAATAATTAGTGCAACCTTCAGATGCTTCT
CGCTAAATGCTCATCTCTAAATTATCATTATTATTCCTAATAAATCCTAAAATTTTTCAC
TCGTTCTGTACGGCTCATCGCCCCAATATTACCCGTCTTGTATGTGATCTTTTTGACTTT

TCGGTGGCAAAATGCAAAGGGGAATCCAAGGAAAAACCATAACAGGACACTACATCAGAG
ATAATCTTGAATTAAGAGAGTAGAGGAATATACTGCTGGGCTCACTACCATTTTTGTTGC
TAGAGTAAACGTAGAGAAAGATGTCAAGAGATGCACCAATTAAGGCTGACAAGGATTATA
GCCAAATTTTGAAGGAAGAGTTTCCTAAGATCGATTCGCTCGCTCAAAATGATTGTAACT
CTGCTTTAGACCAACTGTTAGTGTTGGAGAAGAAACCAGACAAGCTTCAGATCTGGCCT
CCTCGAAAGAAGTTTTGGCCAAGATTGTAGATCTGCTAGCATCAAGGAATAAGTGGGACG
ACCTAAATGAGCAATTGACTCTACTCTCAAAAAAGCATGGTCAGTTGAAATTGTCAATTC
AGTATATGATACAAAAGGTTATGGAATATTTGAAAGCTCGAAATCTTTGGATTTAAACA
CCAGAATTAGTGTCATTGAAACTATCAGGGTGGTTACAGAGAACAAAATATTTGTAGAAG
TGGAAAGAGCTAGGGTCACCAAAGATTTGGTGGAAATTAAGAAAGAAGAGGGTAAGATTG
ATGAAGCTGCAGACATCTTGTGTGAGTTACAGGTTGAGACCTATGGCTCCATGGAAATGT
CTGAGAAAATTCAGTTTATATTAGAGCAAATGGAATTGAGTATATTAAAAGGTGATTATT
CCCAAGCCACGGTGCTTTCAAGAAAAATTCTGAAAAAACTTTTAAAAATCCAAATACG
AGTCATTGAAGCTAGAATATTATAATCTTCTGGTAAAAATTAGTTTGCACAAGAGAGAAT
ACCTAGAAGTTGCGCAGTATCTGCAAGAAATTTATCAAACAGACGCCATTAAATCAGATG
AGGCTAAGTGGAAACCTGTTTTATCGCACATTGTATATTCTTAGTCCTTTCACCTTACG
GCAATTTACAAAATGATTTAATTCACAAAATCCAGAATGATAACAACCTGAAAAAATTAG
AAAGCCAAGAATCTTTAGTAAAATTGTTTACTACGAATGAGTTGATGAGATGGCCAATTG
TTCAAAAAACCTATGAGCCCGTCTTAAATGAGGATGATTTGGCATTTGGTGGAGAAGCTA
ATAAGCATCACTGGGAAGATTTACAAAAAAGGGTCATCGAGCACAATTTAAGAGTCATTT
CCGAATACTATTCCAGAATTACTTTACTAAGATTGAATGAATTGCTGGACCTAACGGAGA
GCCAGACGGAAACATACATCAGTGATTTGGTAAACCAGGGCATCATATACGCTAAAGTTA
ATCGCCCAGCCAAAATCGTGAATTTTGAAAAACCAAAAAACTCAAGCCAATTATTGAACG
AATGGTCACATAATGTTGACGAACTATTAGAACATATAGAAACAATAGGCCATTTAATTA
CAAAAGAGGAAATCATGCACGGTTTGCAAGCTAAATGA

YDL147W, 445 aa (SEQ ID NO 88)
MSRDAPIKADKDYSQILKEEFPKIDSLAQNDCNSALDQLLVLEKKTRQASDLASSKEVLA
KIVDLLASRNKWDDLNEQLTLLSKKHGQLKLSIQYMIQKVMEYLKSSKSLDLNTRISVIE
TIRVVTENKIFVEVERARVTKDLVEIKKEEGKIDEAADILCELQVETYGSMEMSEKIQFI
LEQMELSILKGDYSQATVLSRKILKKTFKNPKYESLKLEYYNLLVKISLHKREYLEVAQY
LQEIYQTDAIKSDEAKWKPVLSHIVYFLVLSPYGNLQNDLIHKIQNDNNLKKLESQESLV
KLFTTNELMRWPIVQKTYEPVLNEDDLAFGGEANKHHWEDLQKRVIEHNLRVISEYYSRI
TLLRLNELLDLTESQTETYISDLVNQGIIYAKVNRPAKIVNFEKPKNSSQLLNEWSHNVD
ELLEHIETIGHLITKEEIMHGLQAK

YDR253C, 1076 bp, CDS: 501-1076 (SEQ ID NO 113)
TTTCCCCGCTAAAATAACGCCAGATGCTTTCTATGCTTCTAATCTTTTACCATTTACCTT
TGTTTATTTCAATATAAACTTTAATTTACAGTCCCTATCTATTGCCCGACTGGACTAACA
TGCACGTGACATTTTGTGATGGTTTTTCGTCCCTTACTTAGTACGCTTAGTACGCCACAG
TTTATATTTTCTTGACAATAATAAAGAACCTGATTGTGGGTTAGAACTTGCTATACTTTT
AGTTTAAAATAAGCAGGAAATAATCTTGAGTTCTGTATCATTATTATAAATAAAACTATA
TTTGTTCTCTTTGTCGCCCTCGGAACTTTCCTCATTACATTGACGAGGTATATATAGATA
TAGTAGATATACATATCTATCCATGGTATATATGTATGCATCTGGATAATTGAATAGGGT
TTCATGTCATATGCCAAGAATTTGTTAATAATATAGTGGAAAAAAGTCAAGAGGTATTAT
AAATTTCAAAAAAGTACCAAATGGAGGATCAGGATGCTGCATTTATCAAACAGGCTACAG
AAGCAATAGTGGATGTATCATTAAATATAGATAACATAGATCCTATAATAAAAGAGTTAT
TAGAAAGGGTAAGGAATAGGCAAAACAGGTTACAAAATAAAAAACCAGCACTCATACCGG
CAGAAAATGGTGTTGATATAAATAGTCAAGGCGGTAACATAAAGGTTAAAAAGGAAAACG
CATTACCAAAACCACCGAAGTCCAGCAAAAGCAAACCCCAAGATCGTAGAAATAGTACTG
GTGAAAAAGATTTAAATGTGCGAAATGTTCGTTGGAATTTTCAAGATCATCAGATTTGA
GAAGGCACGAAAAGACACACTTCGCCATATTGCCTAACATTTGTCCTCAATGTGGCAAAG
GTTTTGCAAGGAAAGATGCATTGAAAAGACATTATGATACACTGACATGTAGGAGAAACA
GGACTAAATTACTAACTGCGGGTGGTGAGGGTATCAATGAATTACTGAAAAAAGTCAAGC
AATCCAACATCGTTCATCGTCAAGATAACAACCACAATGGTAGCAGTAATGGCTGA

YDR253c, 191 aa (SEQ ID NO 114)
MEDQDAAFIKQATEAIVDVSLNIDNIDPIIKELLERVRNRQNRLQNKKPALIPAENGVDI
NSQGGNIKVKKENALPKPPKSSKSKPQDRRNSTGEKRFKCAKCSLEFSRSSDLRRHEKTH
FAILPNICPQCGKGFARKDALKRHYDTLTCRRNRTKLLTAGGEGINELLKKVKQSNIVHR
QDNNHNGSSNG

YDR276C, 668 bp, CDS: 501-668 (SEQ ID NO 117)
ACCTTTAGTTCTTAGCATCACCAATCGCAGACATCCAACGTATCCGTGCGCGTAATCCTT
CTCTTGGTAGTTGAGCACAGCATACAGAAGAAGCCGCGCGCAAGCGGTAAATGTCTTTCC
TCCGGCCTTCTAACCACCAAAACCGATCTCGGAACATGGGGGGGGGAAGGTCCTCTGAAT
CGAAAAACCCGAGACAGCGAGAGGGATTTTGCAGAAAATTACAAAGATCACTATTTACTG
CTCCCCTCACTTCCGCAGTCCCCTAATAGCGGAAGATGCAATGGGTGTGGGCTCTGGGTG
CCCTTTAACCACGCCCTCAAAAGGGGGTCCTGGTTATTTTGCGATGGGCGCCTCTATAAA
TACAAAAGAGGAAGTGAGTGTTTTTGTTTTGGAAGAGGGAAAGGAAAAAAAGAAGAAAAT
TTACTATCGGTTGTTGTTTTCGCCAGTATAATACAATTGATTATACATTTTGAACTAAA
CAGCACAGCACAATACAACAATGGATTCTGCCAAGATCATTAACATTATATTATCCCTTT
TCTTACCACCAGTCGCCGTTTTTCTAGCCCGTGGGTGGGGTACTGACTGTATAGTGGATA
TCATTTTGACCATTTTGGCTTGGTTCCCAGGTATGCTATATGCCTTGTACATTGTCCTAC
AAGATTAA

YDR276C, 55 aa (SEQ ID NO 118)
MDSAKIINIILSLFLPPVAVFLARGWGTDCIVDIILTILAWFPGMLYALYIVLQD

YDR377W, 806 bp, CDS: 501-806 (SEQ ID NO 127)
AATACAAGACTTGGTGGTCAGCGGAGCGCTATCCTTAGAGAATTCTATCGACCTCTCTAA
TATCAAGCACACCACATGGAAGGATTGGGAAAGAATCAACAAGAAGGAATTGCTTCGGGG
CAAAAAGGAACACAAAACTCGGTCAAAGTTTTTAACTTTTGAAGAGTTGTGGAACGGTGT
AGAAGGCATATAAAATAGATCGTTAATATATTTCTAACATCTTCTTGTAAATGTAAATAT
TTTAAAAGGGTTGATCTTATTACGGAGAGAACCAATCATATCGAAGGATTTCTCAATAGT
AAGTATCCCGCGCGTGGTCCTCGGGGAAATAGAACGAGAAACTTCAAGTACTTGATAGCA
AGAAAGTGAGTGCTTGGCTTCCCCATTTTGATTATAAAGAAAGGCATTATTTTCTAGGGC
AAGAAAAGACATTGTTGAAATTGTTCCAGAAACTTTCATTTAAAGTCTTTCGTGAAAGGA
GTGGACGTCAAAAAGAAATAATGATTTTTAAACGTGCAGTATCTACATTGATTCCTCCAA
AAGTTGTGTCTTCCAAGAATATAGGTTCGGCACCAAATGCCAAGCGCATTGCTAATGTTG
TTCACTTTTATAAGTCTTTGCCTCAAGGACCAGCACCAGCCATCAAGGCTAACACTAGAT
TGGCCAGATACAAAGCCAAGTACTTTGATGGGGATAATGCTAGTGGTAAACCATTGTGGC
ATTTTGCTCTAGGTATAATTGCCTTTGGCTATTCCATGGAATATTATTTTCATTTGAGAC
ATCATAAAGGTGCGGAAGAGCATTGA

YDR377W, 101 aa (SEQ ID NO 128)
MIFKRAVSTLIPPKVVSSKNIGSAPNAKRIANVVHFYKSLPQGPAPAIKANTRLARYKAK
YFDGDNASGKPLWHFALGIIAFGYSMEYYFHLRHHKGAEEH

YEL039C, 842 bp, CDS: 501-842 (SEQ ID NO 141)
AGTAATTGTCTCCCATTTTTGGTATACGAGCTAGCAGGACCTTTTGCCCAATGACCATTC
CATATTCATCCCACTCACCACCGTCATCGTTGGTATTATTATTATCATTCCGCTTGAAGA
AAAAGAAACGAAAAAGAAATGGATCAGCAGCCGGGTTATAGCGCCCCTTATTGAATTAT
TTTCCTTCGTGCCTTCTCTGAGAAGGGTCTGCAGTCCCCCGCCGAGGGGTCTTTTCCCAC
CTTCTCAAAGCTAATAGCGATAATAGCGAGGGCATTTATTCAAGTTCCAACTACTATAAG
TGGCCGCAAGGGGCAAAGACAAAGGCACACAACATATATATATCGTGTTGTGAAGCTC
GAGAAGATTAGATCAGAATAGTTCTCTTTTTGTTGAGGTTGAAACAAAATCAAAGACTTA
TACAAGAAGATCACATACAAGCATTTATTCACATTACTTTAAGTAAACTTCAGTAAACTA
CATTACATCATAAACAAAACATGGCTAAAGAAAGTACGGGATTCAAACCAGGCTCTGCAA
AAAAGGGTGCTACATTGTTTAAAACGAGGTGTCAGCAGTGTCATACAATAGAAGAGGGTG
GTCCTAACAAAGTTGGACCTAATTTACATGGTATTTTTGGTAGACATTCAGGTCAGGTAA
AGGGTTATTCTTACACAGATGCAAACATCAACAAGAACGTCAAATGGGATGAGGATAGTA

TGTCCGAGTACTTGACGAACCCAAAGAAATATATTCCTGGTACCAAGATGGCGTTTGCCG
GGTTGAAGAAGGAAAAGGACAGAAACGATTTAATTACTTATATGACAAAGGCTGCCAAAT
AG

YEL039C, 113 aa (SEQ ID NO 142)
MAKESTGFKPGSAKKGATLFKTRCQQCHTIEEGGPNKVGPNLHGIFGRHSGQVKGYSYTD
ANINKNVKWDEDSMSEYLTNPKKYIPGTKMAFAGLKKEKDRNDLITYMTKAAK

YER112W, 1064 bp, CDS: 501-1064 (SEQ ID NO 147)
TACTGAAGTCCCTCTAAACCTACTGCCTTTTATTTTTAGGCTCTAAAATAACCATGGACA
ACGTGAATTGGGTAGCATCTTTTTTTTAATAGATAGTTTATTATGTATAACAATAATTTA
AAGATATTCATAGTGATAAGTAATTTTAAATGAGTTTAAAGTACTACTTTTCCTTTACCG
CCAGTTTCCTGTACTATGAAAAAGGCAAATTCCGCATTGTAGCCGCCCACACGCATTTTG
ATCATCAATTACGAAATTTGCCGCACACGTGTCACGTGATAAGCACTCTTACTATCATGT
TTTACGGAGTAGCAATGATGTTCAATTATTGCAGCTTTCTTTCGTGAAATCGTAGTATCA
TAGACCTTCCTAATGATGGAAGCGGTAAAGAAGGAAATCGTAAAGTAAATTAACGAAGT
AGTATTAGTAAAACAGAGTTGAAAAACTGATAAATCTTCAACTCGAACTGAAAAGAAACA
CAATAGAATATTTTTTCTCAATGCTACCTTTATATCTTTTAACAAATGCGAAGGGACAAC
AAATGCAAATAGAATTGAAAAACGGTGAAATTATACAAGGGATATTGACCAACGTAGATA
ACTGGATGAACCTTACTTTATCTAATGTAACCGAATATAGTGAAGAAAGCGCAATTAATT
CAGAAGACAATGCTGAGAGCAGTAAAGCCGTAAAATTGAACGAAATTTATATTAGAGGGA
CTTTTATCAAGTTTATCAAATTGCAAGATAATATAATTGACAAGGTCAAGCAGCAAATTA
ACTCCAACAATAACTCTAATAGTAACGGCCCTGGGCATAAAAGATACTACAACAATAGGG
ATTCAAACAACAATAGAGGTAACTACAACAGAAGAAATAATAATAACGGCAACAGCAACC
GCCGTCCATACTCTCAAAACCGTCAATACAACAACAGCAACAGCAGTAACATTAACAACA
GTATCAACAGTATCAATAGCAACAACCAAAATATGAACAATGGTTTAGGTGGGTCCGTCC
AACATCATTTTAACAGCTCTTCTCCACAAAAGGTCGAATTTTAA

>YER112W, 187 aa (SEQ ID NO 148)
MLPLYLLTNAKGQQMQIELKNGEIIQGILTNVDNWMNLTLSNVTEYSEESAINSEDNAES
SKAVKLNEIYIRGTFIKFIKLQDNIIDKVKQQINSNNNSNSNGPGHKRYYNNRDSNNNRG
NYNRRNNNNGNSNRRPYSQNRQYNNSNSSNINNSINSINSNNQNMNNGLGGSVQHHFNSS
SPQKVEF

>YFR010W, 2000 bp, CDS: 501-2000 (SEQ ID NO 153)
GAAAAATTTCAACGGTGGTGTCTTAATGGTTTCCCATGATATCTCTGTTATTGACTCTGT
TTGTAAAGAGATTTGGGTTTCAGAGCAAGGTACTGTCAAGAGGTTCGAAGGTACAATTTA
CGACTATAGAGATTACATCTTGCAGTCTGCTGATGCTGCAGGTGTGGTTAAAAAGCATTG
ATTATTTAGGAAGCACCTCAGAATATATTTTCCATAGAAGCCTAAATTAAGTATGCATTC
ATAGCCCCATGATACTTTTTTTTTTGACTACTTGTATTGGAATCTAATTGACCTAACTGG
GCATTCTGGGTCATTGGTATATGTATCACTTTTTACGTAAAAAGTAGTGGCTAATATAA
AACATAAAATCTACAAGAAGGGTGAAGTGCTTTTCGAATTTTGCCACTGCAAGTAATTGG
TGCAATTGAAATACGAGATTTCGTTCTCTAAGAGGATATAAAAATAAGGAAATTAGCCCT
ACCTATCCTTGTGTTAAAATATGAGCGGAGAAACGTTTGAGTTCAATATTAGACATTCTG
GTAAAGTTTACCCAATAACACTTTCCACTGATGCTACTTCAGCAGATTTGAAAAGCAAAG
CAGAGGAATTGACCCAAGTCCCAAGTGCCCGCCAAAAATACATGGTTAAAGGTGGCTTGT
CTGGCGAAGAGTCCATTAAAATATATCCCTTAATCAAGCCAGGATCGACAGTAATGCTAT
TGGGGACTCCAGATGCTAACCTGATTTCTAAACCAGCCAAAAAGAATAATTTCATTGAAG
ACCTTGCGCCTGAGCAACAAGTCCAACAATTTGCTCAATTGCCTGTTGGTTTCAAGAATA
TGGGCAACACCTGTTATCTGAATGCTACCCTACAGGCTTTATACAGAGTGAACGATTTAA
GGGATATGATTCTTAATTATAACCCTTCTCAAGGTGTGTCTAACAGTGGTGCACAAGATG
AAGAGATTCACAAACAAATCGTTATTGAAATGAAGCGTTGTTTTGAAAATTTACAGAATA
AAAGTTTCAAGAGTGTTTTGCCAATTGTGTTATTAAACACGCTAAGAAAGTGTTATCCAC
AATTTGCTGAACGTGATTCACAAGGTGGGTTCTATAAACAGCAAGACGCTGAGGAGTTGT
TTACACAACTATTCCATAGTATGAGTATTGTTTTGGTGACAAATTTTCCGAAGATTTCA
GGATTCAATTTAAAACTACCATCAAAGACACAGCTAATGATAACGATATTACTGTTAAAG

AAAATGAAAGCGATTCTAAATTACAATGTCATATTTCTGGTACTACAAATTTCATGAGAA
ATGGGCTCCTGGAAGGTTTGAATGAGAAAATTGAAAAAGATCAGACTTGACTGGCGCCA
ATTCCATCTATAGCGTCGAAAAGAAAATATCAAGATTACCAAAGTTTTTAACTGTTCAGT
ACGTTAGATTTTTCTGGAAAAGGTCAACCAACAAAAAATCTAAAATATTGCGTAAGGTCG
TTTTCCCATTTCAATTAGATGTTGCAGACATGCTTACCCCAGAATACGCAGCAGAGAAGG
TAAAAGTTCGTGACGAACTGAGAAAAGTTGAAAAGGAGAAAAATGAAAAGGAAAGAGAGA
TCAAAAGGCGTAAATTTGACCCATCATCCAGTGAAAATGTCATGACACCAAGAGAACAAT
ATGAGACACAAGTGGCTCTTAACGAAAGTGAAAAAGATCAATGGCTCGAAGAGTATAAGA
AACATTTTCCTCCAAACTTGGAAAAAGGTGAAAACCCATCTTGTGTTTATAACTTGATCG
GTGTCATTACACATCAAGGTGCCAATTCTGAGTCTGGACACTATCAAGCTTTCATAAGGG
ACGAACTGGACGAAAATAAATGGTACAAATTTAATGATGATAAAGTTAGCGTTGTTGAAA
AGGAAAAAATTGAATCTTTAGCCGGTGGGGGCGAAAGTGATAGTGCACTGATCTTAATGT
ATAAAGGATTTGGTCTGTAA

>YFR010W, 499 aa (SEQ ID NO 154)
MSGETFEFNIRHSGKVYPITLSTDATSADLKSKAEELTQVPSARQKYMVKGGLSGEESIK
IYPLIKPGSTVMLLGTPDANLISKPAKKNNFIEDLAPEQQVQQFAQLPVGFKNMGNTCYL
NATLQALYRVNDLRDMILNYNPSQGVSNSGAQDEEIHKQIVIEMKRCFENLQNKSFKSVL
PIVLLNTLRKCYPQFAERDSQGGFYKQQDAEELFTQLFHSMSIVFGDKFSEDFRIQFKTT
IKDTANDNDITVKENESDSKLQCHISGTTNFMRNGLLEGLNEKIEKRSDLTGANSIYSVE
KKISRLPKFLTVQYVRFFWKRSTNKKSKILRKVVFPFQLDVADMLTPEYAAEKVKVRDEL
RKVEKEKNEKEREIKRRKFDPSSSENVMTPREQYETQVALNESEKDQWLEEYKKHFPPNL
EKGENPSCVYNLIGVITHQGANSESGHYQAFIRDELDENKWYKFNDDKVSVVEKEKIESL
AGGGESDSALILMYKGFGL

>YFR052W, 1325 bp, CDS: 501-1325 (SEQ ID NO 157)
CAGAGACATGTTTTAATTCAAGTGATGAGGCGGAAACGTGCAAGATCCTAAATGAAGGAT
AAAAAGAGTTCTTAAAAAGGGAAGTAAGGAATAACAGAGTAGAAAAACCGAAAAGACAAC
TTAACAAATCGGCAACACTTTTATGGGGCCCCGCTCGCCTGTGTGCAAGTAGTATTCGAC
CTGGAACACGCATTTACCACGAGAAGACAGCAATAGTCCGTACAACATTAATTAGTTTCG
ACAATTGCTCGCCTTTATAAGCCATGCTAGTGCCCAATCAAACACTTTACTTGCCCTGAA
GTTCCTTTTTTCGCTAGCCTGTAACTTAAATAAGCCATCTAACCTTTTTTTTCTAAAAAT
TTTCTTTATTACCCTGTCGGCTTATTTTCTATTCTACACATTATTTGCCACCCATTGAAA
TTGTAGCTTGTATTAATAGGGAAAAGCCGGAAGTATAACCGGTGGAAAGTACTATTGAAG
TGAGATAAGAAGCCATCGTAATGCCCTCGTTAGCCGAATTGACCAAGTCGTTAAGCATAG
CCTTTGAAAACGGCGATTATGCCGCGTGTGAGAAGCTCTTGCCCCCTATCAAGATCGAAC
TTATCAAGAATAACCTTTTAATACCTGACTTATCCATTCAAAATGACATCTATTTGAATG
ATTTGATGATTACTAAAAGGATCCTGGAAGTAGGTGCCCTTGCTAGCATCCAAACTTTCA
ATTTTGACAGCTTCGAGAATTACTTCAACCAATTGAAGCCTTACTACTTTAGCAACAATC
ATAAATTATCTGAATCTGACAAGAAATCGAAGCTGATAAGTCTGTATTTGTTGAACTTAT
TGTCTCAGAATAACACAACCAAGTTTCACTCGGAATTGCAGTATCTAGATAAACATATCA
AGAACTTGGAAGACGATTCACTTTTGTCTTACCCTATCAAACTAGACAGATGGCTCATGG
AAGGGTCGTACCAGAAAGCATGGGATCTTCTGCAATCTGGGTCGCAGAATATATCAGAAT
TCGACTCTTTTACCGATATCCTAAAATCAGCTATAAGAGACGAAATTGCTAAAAATACCG
AGCTATCCTACGACTTTCTCCCTCTCTCCAACATAAAGGCTTTGCTCTTTTTCAACAACG
AAAAAGAAACTGAAAAATTTGCACTAGAGAGAAACTGGCCTATTGTCAACTCGAAAGTTT
ACTTCAATAACCAATCAAAGGAGAAAGCTGATTACGAAGATGAAATGATGCATGAAGAAG
ACCAAAAGACAAACATTATCGAAAAGCAATGGATTATGCCATAAGTATTGAAAATATTG
TGTAA

>YFR052W, 274 aa (SEQ ID NO 158)
MPSLAELTKSLSIAFENGDYAACEKLLPPIKIELIKNNLLIPDLSIQNDIYLNDLMITKR
ILEVGALASIQTFNFDSFENYFNQLKPYYFSNNHKLSESDKKSKLISLYLLNLLSQNNTT
KFHSELQYLDKHIKNLEDDSLLSYPIKLDRWLMEGSYQKAWDLLQSGSQNISEFDSFTDI
LKSAIRDEIAKNTELSYDFLPLSNIKALLFFNNEKETEKFALERNWPIVNSKVYFNNQSK
EKADYEDEMMHEEDQKTNIIEKAMDYAISIENIV

>YGL072C, 860 bp, CDS: 501-860 (SEQ ID NO 159)
ACTCTTTTGCTAGGGAGTTTCTGTCGCTAAGAGGTTTGTCAATGACACCGAAAAGAGGAT
AATAGGTAATACTTTTTGTAACTGTAAAGAATATTAAATCGTTTTCACGGAATTGGCCTC
TTCCCTATATTCTATCCGAGGTTGTGTACTGTAGCGGTTTATACTTCAACCTGTGAAAGT
TATGTAATATGCGAATTCTGTTTCTGCTTGATAATCTGAAGAATATAGTCTCGAGCACGC
GATGGAGCAGAAAGGGGAGAAATGAATACTGATGAGCTTAACGATGAGGAGGCCGTTTCC
GTTTCTCTTGATTACCCTTTCATCCAACAGTCAATATAAGTACGCCAACTTGCGTTAAAA
CGGCCAATGTGACACCAGTTCACTCGGCAAGCCCTTCTCAGGCTCTCACTAGCTCAATA
ACGAGAACTCTTCACGACTCATCTACTTGGCATTTTCCGGGTGCAGTTCAACCTCACTCG
CGTGCGGCGGTGTGAGGTGCATGGGTGCCGGTATTTTTTTAGTTCGCTCTGCGCCTTAC
GCGATCAGCTTCGAGAACATACTATATTAAATGATTATATACGCTATTTAATGACCTTGC
CCTGTGTACTATTTCTTAGCTCGTTTGGGCAGGCGGTGATCGTTGTACTCTGTCGGGTCC
TGTATTTCGACTATAGCCGGTTCCGGTATTTCCTCCACAAATCTTTTCTTAGCGTTCTCG
GGCGCCGTGTCGGCCTGGGTGGAATAACTGTGGTCATTAAAGCTTGGCAGGTTATCACTC
ACTTTAGTGTTTTCAGTGGCGCTGAACTTTATATCGGGGACACCCTTGTACTTCCCTCA
CTAGTGTTATTGTCGTTTAG

>YGL072C, 119 aa (SEQ ID NO 160)
MGAGIFFSSLCALRDQLREHTILNDYIRYLMTLPCVLFLSSFGQAVIVVLCRVLYFDYSR
FRYFLHKSFLSVLGRRVGLGGITVVIKAWQVITHFSVFSGAELYIGGHPCTSLTSVIVV

>YGL080W, 893 bp, CDS: 501-893 (SEQ ID NO 161)
GAAGAAAAAGAAGAAGGGGATGATGAGGAAGGAGAAATAGAACTTGAAATTATTAGAGTA
AAAAGAATAAAGGGCAGGACGAAGATAAAGAAGACGCTTACTTGCTTCTCGAAAAACAAG
AAAATTATTACCCCTCAGCACTCCAATAGTATGTGGTTACTACTAATAGTAATCTTGATT
TTTGACCGCCTACTATCGAATTAAATATAATTTTATAACCCAGTTCTATATTGCTGGGTG
GTATTATAGCTTCATGGCTAGTCAAATAAGTGGAGTTTTTTGCTCTGGACGTGGCCTGTA
AAGTTCTCTTTTGCGACGGCCCCCCGCTTTAACCGAGGCGAAATGACAAGTGCTTTCTGG
CAAAGAAGGAATAGCCACTACAACCTGCGGTCTCCACCTTTCTCCACCGATAATCTATTT
AAACACTCACTTGCCAATCAGCAAACGTCAATACATCTACATATATACGTATAGATTTTA
TTGCACTGTGATCAAAAGAATGTCTCAACCGGTTCAACGCGCTGCAGCACGCTCATTCC
TTCAAAAATACATCAATAAAGAAACTTTGAAATATATTTTCACAACACACTTCTGGGGTC
CCGTATCAAATTTCGGTATCCCAATTGCTGCTATATATGATCTGAAAAAAGACCCTACAC
TAATCTCTGGCCCAATGACTTTTGCTTTAGTTACCTATTCAGGTGTTTTCATGAAGTATG
CTCTTTCAGTATCACCCAAAAACTACTTACTGTTTGGATGCCACCTTATTAATGAAACTG
CGCAATTAGCTCAAGGCTATAGGTTTCTCAAATACACGTATTTCACAACAGATGAGGAGA
AGAAAGCTCTAGATAAGGAATGGAAAGAGAAAGAAAAAACTGGTAAACAGTAA

>YGL080W, 130 aa (SEQ ID NO 162)
MSQPVQRAAARSFLQKYINKETLKYIFTTHFWGPVSNFGIPIAAIYDLKKDPTLISGPMT
FALVTYSGVFMKYALSVSPKNYLLFGCHLINETAQLAQGYRFLKYTYFTTDEEKKALDKE
WKEKEKTGKQ

>YGR008C, 755 bp, CDS: 501-755 (SEQ ID NO 165)
CGCAATAGTTATGAACTTAACCGAGCTCAAATAATTTAAAGATAAAAGATAAAGATAAA
AGATAAAAGACAAAAGAAAATTCATAGCCCATGTTGAAGTATCCCAGCGGGAAATGTTGC
TATCCAACAGAAAGTACCAAGCCAGTTTCAAAAAGGTACAGAATTAAGTGATGCTATCCG
TCCCACAACTAATTTTCTCCAGCGGAGGAAATATACGCGGAGGGGGGAGGAAAACCTCT
CAGTAAGCAATGAAGGGATAGATAATGGGGCGCGCCTGCCTAGCTTAGGCTAAGAAACT
CCTTCGAAAACAGGGGGCTGCGAGCGCAGAAGCGAACACTTGTCATTTGTATAAAAGGAC
TATTTATAAGTTTGCTTTTTGTCACTCTCTTGGCCCTAATTACCCATACTATTGTAACAA
TTGTTGTGTAAACTCAATTATACAAATAAACGAACAATCAACAGTAACAAACCGCTCAAG
TGTACAACCAATCAGAAAAATGACGAGAACAAACAAGTGGACCGAACGTGAAGGAAAGG
CTGATCCAAAGTACTTTTCGCACACTGGTAACTACGGTGAATCTCCAAATCACATCAAGA
AGCAAGGTTCCGGCAAGGGTAATTGGGGTAAGCCAGGCGATGAGATTGATGACTTAATTG
ATAATGGTGAAATACCCCCAGTGTTCAAGAAAGATAGAAGAGGCTCAAATTTGCAATCGC

ATGAACAAAAGTTTGAAAACGTCCAAAAGGAATGA

>YGR008C, 84 aa (SEQ ID NO 166)
MTRTNKWTEREGKADPKYFSHTGNYGESPNHIKKQGSGKGNWGKPGDEIDDLIDNGEIPP
VFKKDRRGSNLQSHEQKFENVQKE

>YGR023W, 2156 bp, CDS: 501-2156 (SEQ ID NO 167)
TTAGATCATGGCTAGGGGGATCTGGAAGTACAATGATGTGCTCTCCCCCTCTCAAACACA
ACACCAGGATGAACTAAGGGCTCATCTCGAAAGTCGAAGGTGCCTCATTCAGGTTATTAG
TGGTGCCTGTTGTGTCTTCCATGAACAAGGAGCACTTAATTACTTGTTGTTGCATGAGAT
ATCATTTTTTTTTTTCCCTCTTTCTTGGGGTCTTGACAGTCATCAAATCGAAGTTTTTAG
TTTTTCTTCTTCGGGAAGATCAATTTTAGGTAGAAAAGTGTAGATGAAAAACGAAGGATA
CTGCTATTTACTGTAAGTACTCTTCGGTCCATATTGGAAGACCAAGGCATAATAAGGATA
TATTCCGAGGAGATAATTGGGATATAATCCTCCATTGCTTCCGAAATTTGTTTAAACACT
TCTAGTTCATTTCGGGTTGGTTCGATCTTCGTTTCCACTTTTAACTTACTCCCAGTTAGT
ATAATATAAGTAGTTAAGGTATGGCAAGCTGCAATCCGACCAGGAAGAAGAGCTCTGCTT
CAAGCCTATCTATGTGGAGAACGATTCTCATGGCGTTAACAACACTACCGCTAAGTGTTC
TTTCGCAGGAGTTGGTTCCAGCTAATAGCACAACATCGAGCACAGCTCCTTCCATCACTT
CGCTTTCCGCAGTTGAGTCATTTACGTCCAGTACCGATGCAACGAGCAGCGCAAGTTTAT
CAACGCCGAGTATAGCTTCAGTATCCTTTACTTCCTTCCCACAAAGTTCTTCACTGCTTA
CTCTTTCGTCAACATTATCCTCAGAACTTTCCTCTTCGTCCATGCAAGTTTCGTCGTCTT
CAACATCGTCGTCTTCTTCGGAGGTTACGTCATCATCGTCATCATCATCAATATCTCCTT
CCTCTTCATCATCAACAATAATATCATCGTCATCATCACTGCCGACATTCACTGTGGCAT
CAACATCTTCGACAGTTGCCTCCTCCACACTTTCCACTAGCTCATCGTTGGTTATCTCTA
CGTCTTCGTCAACGTTTACGTTTAGTTCGGAAAGTTCAAGCTCTTTGATTTCCTCTTCAA
TTTCAACATCCGTTTCGACTTCTTCAGTGTACGTTCCCTCCTCTTCAACTTCATCTCCAC
CTTCGTCCTCATCCGAATTGACATCATCCTCGTACTCATCATCCTCATCCTCATCCACCC
TCTTTTCCTACTCCTCCTCATTTTCATCATCCTCATCCTCATCATCCTCATCATCATCCT
CATCCTCATCATCATCATCATCATCATCATCATATTTCACCCTCTCCACATCTTCCTCTT
CATCCATATACTCGTCTTCGTCATATCCTTCATTTTCATCTTCATCTTCCTCAAACCCTA
CCTCATCAATCACTTCTACATCCGCCTCATCTTCTATTACTCCCGCTTCCGAATATTCCA
ATTTGGCAAAAACCATAACTAGTATAATAGAAGGCCAGACCATCCTCTCTAACTACTATA
CCACAATAACGTATTCACCGACAGCATCCGCATCTTCAGGAAAAAATTCACATCACTCAG
GCTTATCAAAAAGAATCGTAATATTATCATCGGTTGTGTGGTTGGCATAGGTGCCCCCC
TCATCCTAATTCTACTAATATTGATTTACATGTTTTGTGTTCAGCCTAAAAAAACGGATT
TCATTGACTCTGACGGTAAAATTGTCACAGCTTATCGTAGTAACATTTTCACCAAAATAT
GGTATTTCTTGCTGGGTAAAAAAATTGGTGAAACAGAAAGATTCAGCTCAGATTCCCCCA
TCGGCAGCAATAATATTCAGAATTTTGGTGATATCGATCCAGAAGATATACTTAACAATG
ACAACCCCTACACCCCTAAACACACTAATGTTGAAGGCTACGACGACGACGACGACGACG
ACGCTAATGATGAAAACCTATCATCCAACTTCCATAACAGAGGCATAGATGATCAATACT
CACCTACTAAATCTGCATCATATTCAATGTCGAATAGTAATAGTCAAGATTACAACGACG
CAGATGAAGTAATGCACGATGAAAACATTCATCGTGTTTATGATGACAGCGAAGCTAGCA
TCGACGAGAACTATTACACGAAACCAAACAACGGCTTAAATATCACGAACTATTAA

>YGR023W, 551 aa (SEQ ID NO 168)
MASCNPTRKKSSASSLSMWRTILMALTTLPLSVLSQELVPANSTTSSTAPSITSLSAVES
FTSSTDATSSASLSTPSIASVSFTSFPQSSSLLTLSSTLSSELSSSSMQVSSSSTSSSSS
EVTSSSSSSSSISPSSSSSTIISSSSSLPTFTVASTSSTVASSTLSTSSSLVISTSSSTFT
FSSESSSSLISSSISTSVSTSSVYVPSSSTSSPPSSSSELTSSSYSSSSSSSTLFSYSSS
FSSSSSSSSSSSSSSSSSSSSSSSYFTLSTSSSSSIYSSSSYPSFSSSSSSNPTSSITST
SASSSITPASEYSNLAKTITSIIEGQTILSNYYTTITYSPTASASSGKNSHHSGLSKKNR
NIIIGCVVGIGAPLILILLILIYMFCVQPKKTDFIDSDGKIVTAYRSNIFTKIWYFLLGK
KIGETERFSSDSPIGSNNIQNFGDIDPEDILNNDNPYTPKHTNVEGYDDDDDDDANDENL
SSNFHNRGIDDQYSPTKSASYSMSNSNSQDYNDADEVMHDENIHRVYDDSEASIDENYYT
KPNNGLNITNY

>YGR034W, 1244 bp, exon1: 501-525, intron1: 526-879, exon2: 880-1244 (SEQ ID NO 169)
TATAAAAAAAATTCTTGTAGACAATAAAATAAGAAATGCCCATTTTGTAACTTAGCGAAA
GATGCCCAGTACATCCCTTTTACACCCGTGCATTAAAGGTGTTTGGGTTTAATAGGAGCT
TTATCATATCTCTTTGATTTTTTTTCTGCTGTCCTCGGCTTGAGGGACTCACAGAGATCT
GGAAATTTTCAGATTGTCAGTGCTTAGGATGGGTTGTCAGTAGACGGTGGCCGCCGTGGA
TGGGAAATCTCATACGTTTACACACATAGTGTTTGGAAATTAATAGTAGCAATAGCTATC
TGGCTACTGTTTTAAAGTATTAGCCCGTTCTCAGTGCTTCTTTTTTAAGGAATAACAACG
GCAAGACCAAAGATATATCAAATATGGCTAAGCAATCTCTAGGTATGTTTGGAGGATACG
AATAACGATAGAAAACATGAGTGAATTTCCGTCCACGAAAAAATGTTAACATAAAATGCA
AGAGAACAATTAATCGAATAATGTTAAATTATTGTAAAACAATGTGTATGATGAGGAGGA
ATGTACCTAAGCCAAAAAAAAAAAAAAAAAAAAAAAAAAAAAAAAGAAACAGCTTTTGCAT
ATTCAATCCAGGCATAGGGCGACTATTTAGCACTCAACGATTTTTAAGCTTGTGTATTGC
TGACATAAATTCCGGCTTTAGAATCCAATATTGAAAACGTGAGTACGCAGAGGAGATAG
AAGAAAAGTAGGAAGTTACCGTTTATATTGATTTGTGAAATGCATACTCCGTTGGATGTG
GGGCAACATAGATTTAAGTGTGGATGAAAATTATGTGCTCATTGTGAAAAAAAGTTTTG
CTTTTACTAACAAATTTTTTTATTATTTGTTTTCAATAGACGTTTCCTCTGACAGAAGAA
AGGCCAGAAAGGCTTATTTCACTGCTCCATCCTCTGAACGTCGTGTTTTGTTATCTGCTC
CATTATCCAAGGAATTGAGAGCTCAATATGGTATCAAGGCTTTGCCAATCAGAAGAGACG
ATGAAGTCTTGGTTGTTCGTGGTTCCAAGAAGGGTCAAGAAGGTAAGATTTCATCTGTTT
ACAGATTGAAGTTTGCTGTTCAAGTTGACAAGGTCACCAAGGAAAAGGTCAACGGTGCTT
CCGTTCCAATTAACTTGCACCCATCCAAGCTTGTTATCACTAAGTTACACTTGGACAAGG
ACAGAAAGGCTTTGATCCAAAGAAAGGGTGGTAAATTGGAATAA >YGR034W, 129 aa (SEQ ID NO 170)
MLNYCKTMYVSSDRRKARKAYFTAPSSERRVLLSAPLSKELRAQYGIKALPIRRDDEVLV
VRGSKKGQEGKISSVYRLKFAVQVDKVTKEKVNGASVPINLHPSKLVITKLHLDKDRKAL
IQRKGGKLE >YGR069W, 836 bp, CDS: 501-836 (SEQ ID NO 171)
TTCGAATTATTTTGTTGAAAACAGGGCTCGAAAGTGATCTCTTGCTTAGAAATATTGCGT
TGCCGCTGGTGTCCATATCTTGGTTGCTTGTACTGCGACCGCTACTACTGTTATGTTGAT
TTTCCGCATTTTCCCCACCGACTAAAACATCCCCTTTTGAAGAAACCAATAAGTTGTCCC
AATAGCATTCGAAAATCTTACGCTTTTCCTTAACTAGACTTGCCAAACTACTGCTATTCT
TCTTATATCGGCCAACTTGCAAAAACTCCAATTTGAATCTTCCTACCAATCTCAGCGAAA
TTTTCTTCACTACGATCTCATTTTTCACTGAAATCACTAAGTTTCCTGATAAAGGTATAG
ACGACAGTTCCAACGGTGACCCTTGGATCAAAATTATGTCCTTGTACGGGGAGTTTATTC
TAATATCAAAATAACTTATTCTCTCTCTTTCCTTCTGCTCTGAATGCCCACCGCTGCTAG
ATAGCGAACTAAGTGAAAACATGGTCTTGCTTCACCCTATTCTCGCCGAGAGCTGTACAA
GATATTTTTTACTTTTGCCATCTTATACTCATCCTAATCATCTGTTTCATTTTCCTTCTA
TTTCTTTTTTTTTTTTTTTTTTTTTTTTTTTTTTCAGTTTTCGAAGAAACTGCCTTTTTA
GAATTGTAAAAGACGAAGTGAAGTATTCAGGAGTATATTATTACATACATACAAAGCAAG
ACAAAGAAACATTTTTAGATCTAACATTTTACTTCAATTGTTTTTGTATTCCTTATAATA
AGAAAGACCTGCTGTTTAATGTGGGAGTAATCCGTCCCCTACTCGATCTTCAATAA >YGR069W, 111 aa (SEQ ID NO 172)
MVLLHPILAESCTRYFLLLPSYTHPNHLFHFPSISFFFFFFFFFFSFRRNCLFRIVKDEV
KYSGVYYYIHTKQDKETFLDLTFYFNCFCIPYNKKDLLFNVGVIRPLLDLQ >YGR070W, 3968 bp, CDS: 501-3968 (SEQ ID NO 173)
AAGAAACATTTTTAGATCTAACATTTTACTTCAATTGTTTTTGTATTCCTTATAATAAGA
AAGACCTGCTGTTTAATGTGGGAGTAATCCGTCCCCTACTCGATCTTCAATAAATTGTCA
TCTTGTATCTAAAGGAGCGCTCCAGTACTCCAATTAAGCACCACCTAGTGCGTCTAGTGT
CGATTTTTTTTCACGCATACGTTTGTATGTTTCTTAAATTTCCCATGATTTTTTGTTGC
CAATGTCATATCTACAAACTCTATACGAAAGTAAACGCACTTCATCTTTTTTGCCCTAAA
ACGGCAATATTTAGACATATCATAAGGGGCCCAAGGGAGAATCGTTAATTTTAAACTTTT CTTTGCTCTTGAATGAAAAAGTAAATAAATAAAACTAAATCAAAAAAAAGAACGCCACGT
TTGAATTTTAAAGCAAAAATTTTGTTGATTTAGTAATGATATAAATAAAACCAAGTCGTT
GGTAAGAATTTGGTTAGGTTATGAATAGTAATGAACTGGATCTAAGAAATAAATATTTTT
ATGAGATATTCGGTAAGAAAAGAAAATCAGATACTTCAACCCCTACTCAGTTGTTCTCCG
GCTCCAAAGTTCAGACAAACATCAATGAAATTTCTATCACTAACGATGAGGATGAAGATA
GTACTGAAGATGAAAATAAGGCTTCATTGAAGGATTATACACTAGGGCACGACACCGGTG
CACGGTATAGGATAGCACCGGACTGTTCTTCCCACCAATTAAAGGCATCTCCTGTCCTAC
ATATTTCAACAAACCTTAATTCAAGTCCACAATCCTTCACAGGCGATCAGATTTCACCTA
CTAATAAAAAATTTCAATAAATGATTCGACCAGACAAGATAAAGGTAACAGTTGCACTA
CCACTTCATCACCTTCTCAAAAAGATCGAATGTTTTGCTTCCTCACGTAAGAAAACATT
CATCTCCTTCACTATTATCATTTTCCAAAAACAGTGGCAGTCATATGGGGGATCCAAACC
AGCTATCTACGCCTCCAACTCCCAAAAGTGCAGGTCACACGATGGAGTTACACAGTTCAT
TCAATGGAAAACATAGTTCTTCTAGCACCTCTTCTTTATTTGCATTAGAGTCACTGAAAA
CCCAAAATAGACGCTCATCAAACTCTTCCAATCATTCTAGTCAATATCGACGCCATACTA
ATCAACACCAACGTCATCATTCAAGGTCCAAATCAAGTCCTGTCTCTCTGACGGAAATAT
CCATGATCAAAGGCACGCCTTTGGTTTATCCTGCACTTTTATCACTAATAGCAATTAAAT
TCAAACAGACCATCAAATTGAGCACGCATAAAAGATGGGGTTACTTTACAGAGATTCCT
TTACAGGAAAACAAGCAATTGATACTTTATGCTTGATCATAGGAAGCTTAGATCGTAATT
TGGGCATGTTGATCGGAAAATCGCTGGAAGCTCAAAAATTGTTCCATGACGTACTTTATG
ACCATGGCGTAAGAGATTCTGTACTGGAGATTTACGAGTTATCTTCAGAATCAATTTTA
TGGCACATCAGTCGCAGAGTTCTACTTCAATTGCCAACACATTTTCTTCATCATCTTCTT
CAGTTAATTCGCTCCGTACTAAAACTGAAATATATGGTGTTTTGTCCCATTGACACATT
GTTATTCCTCTACATGCTCTCTGGAAAAACTTTGCTACTCTATTTCTTGCCCCAATCGTT
TGCAACAACAGGCTAATTTACATTTAAAATTAGGTGGTGGTCTTAAGAGAAATATTTCGT
TAGCACTCGATAAGGAGGATGATGAACGAATTTCCTGGACAAATTCTGTACCAAAGAGCG
TATGGGAATCATTATCCAAACAACAAATCAAAAGGCAGGAGGCAATATATGAGTTGTTTA
CTACAGAAAAGAAGTTTGTAAAATCTTTGGAAATCATCCGAGATACTTTCATGAAGAAAT
TATTAGAAACGAATATTATTCCATCTGATGTAAGGATAAATTTTGTAAAGCACGTTTTCG
CACATATCAATGAAATATATTCTGTCAATAGAGAATTTTTGAAGGCTTTAGCACAAGGC
AATCATTAAGCCCAATTTGTCCTGGAATTGCAGATATATTTTGCAGTATCTTCCTTTCT
TTGATCCTTTTCTGTCATACATAGCATCAAGACCATACGCAAAGTATCTAATTGAAACCC
AAAGATCAGTTAATCCCAATTTTGCTCGTTTTGACGATGAAGTGTCTAATTCTTCCCTGA
GGCATGGGATCGATTCATTCCTATCTCAGGGTGTTTCAAGACCTGGTAGATATTCACTGT
TGGTAAGAGAAATAATACACTTCTCGGACCCAGTAACAGACAAAGATGATCTACAAATGC
TAATGAAAGTCCAAGATCTTTTAAAGGATCTAATGAAAAGGATTGATAGAGCAAGCGGTG
CAGCACAAGATCGTTATGACGTTAAAGTGTTAAAGCAGAAAATTCTATTCAAAAATGAAT
ACGTTAATCTGGGTTTGAATAACGAAAAAGGAAAATCAAGCATGAAGGTTTACTCTCAA
GGAAGGACGTGAACAAAACAGATGCGTCCTTTTCAGGAGACATTCAATTTTACCTACTCG
ACAATATGCTATTATTCTTGAAATCAAAAGCTGTAAACAAGTGGCACCAACACACTGTAT
TTCAGAGACCAATTCCACTCCCTTTACTGTTTATTTGTCCGGCTGAGGATATGCCACCCA
TAAAAGATATGTGACAGAAAACCCAAATTGCTCAGCGGGTGTGCTCTTACCCCAATATC
AAACGAGCAATCCCAAGAATGCTATTGTATTCGCCTATTACGGTACGAAACAACAATATC
AAGTTACTTTGTACGCGCCGCAGCCGGCCGGATTACAGACATTAATAGAAAGGTGAAAC
AAGAGCAAAAAGGCTCCTTGATGAAACTAAACATATTACTTTTAAGCAAATGGTAGGTC
AATTCTTTCACTCATACATAAATACTAATCGCGTCAACGATGTCCTAATCTGTCATGCTG
GTAAAATTTTATTGGTTGCAACAAATATGGGACTCTTTGTTCTTAATTATGCTACATCGA
TCAATCAAAAACCAGTGCACCTTCTGCACAAATATCAATTTCACAGATCTCTGTATTGG
AAGAATATAAAGTTATGATTCTTCTAATTGACAAAAACTGTACGGCTGTCCTTTAGACG
TAATCGACGATGCAGAAATGCAGATTTTCTTTTCAGAAAAATTCTAAAGTGTTATTTA
AATATGTTGCAATGTTCAAAGACGGTTTCTGTAATGGTAAAGAATCATTATGATTGCAC
ATCATTTTTTGCACGCCGCACAATTATTGATTGTTAATCCTTTGATATTTGATTTAATA
GCGGTAATTTTAAAAAAACCTAAAGGCAGGCTTGGTAGATTTTAGCGTTGATTCTGAAC
CTCTGTCCTTTTCTTTTTTGGAGAATAAGATCTGCATTGGTTGTAAAAAAATATCAAAA
TATTAAACGTACCGGAAGTGTGTGATAAAAATGGATTTAAAATGAGGGAGCTTTTAAATC
TACATGATAACAAAGTTTTAGCGAACATGTATAAAGAGACGTTCAAAGTAGTTTCCATGT
TTCCGATAAAAAATTCAACTTTTGCATGTTTTCCAGAACTCTGCTTTTTTCTCAATAAGC

```
AAGGGAAGAGGGAGGAGACAAAGGGATGTTTTCATTGGGAGGGGGAACCAGAACAGTTCG
CGTGTTCCTACCCTTATATTGTGGCAATTAATAGTAACTTTATTGAAATTAGACATATAG
AAAATGGAGAACTTGTCCGCTGTGTACTTGGAAACAAGATACGTATGTTAAAATCATATG
CCAAGAAGATCTTATATTGTTATGAGGATCCTCAAGGATTTGAAATTATCGAACTGTTAA
ATTTTTGA
```

>YGR070W, 1155 aa (SEQ ID NO 174)
```
MNSNELDLRNKYFYEIFGKKRKSDTSTPTQLFSGSKVQTNINEISITNDEDEDSTEDENK
ASLKDYTLGHDTGARYRIAPDCSSHQLKASPVLHISTNLNSSPQSFTGDQISPTNKKISI
NDSTRQDKGNSCTTTSSPSQKRSNVLLPHVRKHSSPSLLSFSKNSGSHMGDPNQLSTPPT
PKSAGHTMELHSSFNGKHSSSSTSSLFALESLKTQNRRSSNSSNHSSQYRRHTNQHQRHH
SRSKSSPVSLTEISMIKGTPLVYPALLSLIAIKFKQTIKLSTHKKMGLLYRDSFTGKQAI
DTLCLIIGSLDRNLGMLIGKSLEAQKLFHDVLYDHGVRDSVLEIYELSSESIFMAHQSQS
STSIANTFSSSSSSVNSLRTKTEIYGVFVPLTHCYSSTCSLEKLCYSISCPNRLQQQANL
HLKLGGGLKRNISLALDKEDDERISWTNSVPKSVWESLSKQQIKRQEAIYELFTTEKKFV
KSLEIIRDTFMKKLLETNIIPSDVRINFVKHVFAHINEIYSVNREFLKALAQRQSLSPIC
PGIADIFLQYLPFFDPFLSYIASRPYAKYLIETQRSVNPNFARFDDEVSNSSLRHGIDSF
LSQGVSRPGRYSLLVREIIHFSDPVTDKDDLQMLMKVQDLLKDLMKRIDRASGAAQDRYD
VKVLKQKILFKNEYVNLGLNNEKRKIKHEGLLSRKDVNKTDASFSGDIQFYLLDNMLLFL
KSKAVNKWHQHTVFQRPIPLPLLFICPAEDMPPIKRYVTENPNCSAGVLLPQYQTSNPKN
AIVFAYYGTKQQYQVTLYAPQPAGLQTLIEKVKQEQKRLLDETKHITFKQMVGQFFHSYI
NTNRVNDVLICHAGKILLVATNMGLFVLNYATSINQKPVHLLHKISISQISVLEEYKVMI
LLIDKKLYGCPLDVIDDAENADFLFRKNSKVLFKYVAMFKDGFCNGKRIIMIAHHFLHAA
QLLIVNPLIFDFNSGNFKKNLKAGLVDFSVDSEPLSFSFLENKICIGCKKNIKILNVPEV
CDKNGFKMRELLNLHDNKVLANMYKETFKVVSMFPIKNSTFACFPELCFFLNKQGKREET
KGCFHWEGEPEQFACSYPYIVAINSNFIEIRHIENGELVRCVLGNKIRMLKSYAKKILYC
YEDPQGFEIIELLNF
```

>YGR132C, 1364 bp, CDS: 501-1364 (SEQ ID NO 177)
```
CATACATGTATCAGACGTATAGCTCCTACGATTCTCAAGAATCCAGAAGTTTGGCATATT
ATGTATAAAGGCGATGATTATGTATATTTTATGTTGTCTCCAGTAAGTGGCAGCATAACC
CGGCCAGTCTGCGCTGCATGCTGTGAAGCAGTAATATGCGATATATACCACATATATTCC
GCTTCCGTTCAGGATTTCGAAAAGAGAAACTTCAGTGAATGACTATGACTACATAGTTGG
AGTCTTAGACCATTGCAAATGAGTTATTCAAGTATGAGAGATCAACACTGATGAGAATAA
ACTCGTCTTCATGATGATACGGGTAACGCGAATGTATCGCATCAATAAATTTCAGGGAAA
GGGAGTTTGACGATCTCATGGATGCAACGGTTGAGGTATATAATATTAAGCAGAAAGAAG
AGGAAAAAAAATAAATCGGTAAACCAACCATCAACGGTACGAAACTTACATTCAAAATCA
ATAATTTACTTTAGAAAAGAATGTCTAATTCTGCCAAACTTATCGATGTCATCACCAAGG
TGGCGTTGCCCATTGGTATAATTGCTAGCGGGATTCAGTACTCCATGTATGATGTGAAGG
GTGGTTCTCGTGGTGTTATTTTCGACAGAATCAATGGTGTAAAGCAACAGGTTGTGGGTG
AAGGCACTCATTTCTTGGTGCCTTGGCTACAGAAGGCGATCATATACGATGTGAGGACGA
AACCAAAGAGCATTGCTACCAATACTGGTACGAAGGATTTGCAAATGGTGTCATTGACCT
TGAGAGTCTTACATAGACCAGAGGTCTTACAGCTACCCGCAATATACCAAAATTTGGGTC
TCGATTACGACGAAAGAGTGTTACCATCTATCGGCAATGAGGTTTTAAAGTCTATAGTAG
CTCAATTTGATGCTGCTGAGTTAATTACTCAGAGAGAATTATTTCTCAAAAAATCAGAA
AAGAGCTTTCTACGAGGGCCAACGAATTCGGTATTAAGTTGGAAGATGTCTCTATCACTC
ATATGACGTTTGGTCCCGAATTCACGAAGCAGTTGAGCAGAAGCAGATTGCACAGCAAG
ATGCCGAAAGAGCCAAATTCCTTGTCGAAAAGGCAGAGCAAGAGAGACAAGCTTCTGTTA
TCAGAGCTGAAGGTGAAGCAGAAAGTGCTGAATTCATTTCAAAAGCCTTAGCTAAAGTTG
GTGATGGTCTGTTATTGATTAGAAGATTAGAAGCTTCTAAGGACATCGCTCAAACATTAG
CAAACTCATCTAACGTTGTCTATTTACCAAGTCAACATTCTGGTGGTGGTAACAGCGAGT
CTTCGGGATCACCAAATTCCTTGCTTTTGAACATTGGCCGTTAA
```

>YGR132C, 287 aa (SEQ ID NO 178)
```
MSNSAKLIDVITKVALPIGIIASGIQYSMYDVKGGSRGVIFDRINGVKQQVVGEGTHFLV
PWLQKAIIYDVRTKPKSIATNTGTKDLQMVSLTLRVLHRPEVLQLPAIYQNLGLDYDERV
```

LPSIGNEVLKSIVAQFDAAELITQREIISQKIRKELSTRANEFGIKLEDVSITHMTFGPE
FTKAVEQKQIAQQDAERAKFLVEKAEQERQASVIRAEGEAESAEFISKALAKVGDGLLLI
RRLEASKDIAQTLANSSNVVYLPSQHSGGGNSESSGSPNSLLLNIGR

>YGR135W, 1277 bp, CDS: 501-1277 (SEQ ID NO 179)
TTCTGAACTGAATCTGAAATTGTTAAACCTGTTTCCCTCAAAGCCTGCAAACAAAGACGA
TAGTTCCCCTATTAACACGTTGCGTAGTTTTATCGCTGATTACTCCTTCGACACCCAGGT
GAACCCTCCAGGAAGAAGGGTGGTGTTCTACGATGGTAAGATTTTGCCATTGCCCAAAGC
CGATAAGCCTATCCCACTTCATGAATATATAACACTCGCAGAGCTCGATGTTGGAGACAG
TGAGTGAGCAGTGAATTGCTCATGTTTTCTCTGCATCCTCATTTAATGACAATTAGCCAT
GTAATAACATCTTGAGGCAGTTAAATATTCGTTACCCTGCAGGTGGCAAAAAATTTATAG
AATAAAAGCATAAAAGATGGATATCTATGTAATAAGGAAACATTGGCAGAGCGAAGAGA
ACAGACTGCTTTCTATAAAAGTTTTCGATCAGTCTCTATTTTAATAATTGATTATTGGA
TATAGTTAGTAGTGTTAAACATGGGTTCCAGAAGATACGATTCCAGGACAACAATTTTCT
CCCCTGAGGGACGTCTATATCAGGTTGAATACGCGCTAGAATCCATTTCACATGCAGGTA
CCGCAATTGGGATTATGGCATCTGATGGGATTGTTCTTGCAGCAGAACGCAAAGTCACAA
GTACTTTACTAGAACAAGACACCTCTACCGAAAAACTTTATAAGTTAAACGATAAAATTG
CGGTTGCCGTTGCTGGACTGACTGCAGATGCAGAAATTCTAATAAATACGGCTAGAATTC
ACGCTCAAAATTACCTTAAAACCTATAATGAAGATATACCAGTAGAAATTTTGGTGAGAA
GGCTAAGTGATATAAAACAAGGTTACACGCAACATGGTGGTTTAAGACCATTTGGTGTGT
CCTTTATCTACGCCGGTTATGACGATAGATACGGTTACCAATTGTATACATCTAATCCAT
CGGGAAACTATACAGGGTGGAAGGCTATTAGTGTTGGCGCTAACACATCAGCAGCACAAA
CCCTACTTCAAATGGACTACAAGGATGATATGAAAGTCGATGATGCCATTGAACTGGCTT
TAAAAACGTTATCCAAAACTACCGACAGTAGCGCGCTGACTTATGACAGGTTGGAATTTG
CTACTATCAGAAAGGGTGCTAATGACGGAGAAGTGTATCAGAAGATTTTCAAGCCTCAAG
AGATAAAGGATATATTGGTAAAGACTGGTATTACCAAGAAGGATGAAGACGAAGAAGCTG
ATGAAGATATGAAATAA

>YGR135W, 258 aa (SEQ ID NO 180)
MGSRRYDSRTTIFSPEGRLYQVEYALESISHAGTAIGIMASDGIVLAAERKVTSTLLEQD
TSTEKLYKLNDKIAVAVAGLTADAEILINTARIHAQNYLKTYNEDIPVEILVRRLSDIKQ
GYTQHGGLRPFGVSFIYAGYDDRYGYQLYTSNPSGNYTGWKAISVGANTSAAQTLLQMDY
KDDMKVDDAIELALKTLSKTTDSSALTYDRLEFATIRKGANDGEVYQKIFKPQEIKDILV
KTGITKKDEDEEADEDMK

>YGR155W, 2024 bp, CDS: 501-2024 (SEQ ID NO 181)
GTGTTCTCATCCGACCCTCTGATTCATTTGGTGGCCATTACATTTTCCCTCAATGACACA
TTCCCCTATTTCATAACTGATTAAAATGGTAATGGCACGTGATAGTAGTGGCTCACAAAA
CAAAATTTTCTTTCTCAGCGCTGACAAAGCTTCATTTGCATTCTAACCTTATCACAACAA
CTTCAACTTCACCCAAGTAAGGATAATCAGCTCTGTCGTGACTGATAAATGCTATATCCG
GCATATGCAGTCCACACGGCATTACCGTTTCACTAATTTATTGCCATCTTCCTCCACAGT
TTTGCACCGAAAGGAAAAAAGAAACCAACACCGAAAATTTTTTTCTCCTAAAGGTTAAA
GTAAACGCAAGGCACTTCACCAGGCTTGTATATATAAATGTCGTGATGCTTCTATGCCAA
AGTAAAAGGCAACACTTGAAGATTTCGTTGTAGGCCACTTGCTCAAAGGACATCTAGATA
AATACGACGTAAGAATAAAAATGACTAAATCTGAGCAGCAAGCCGATTCAAGACATAACG
TTATCGACTTAGTTGGTAACACCCCATTGATCGCACTGAAAAAATTGCCTAAGGCTTTGG
GTATCAAACCACAAATTTATGCTAAGCTGGAACTATACAATCCAGGTGGTTCCATCAAAG
ACAGAATTGCCAAGTCTATGGTGGAAGAAGCTGAAGCTTCCGGTAGAATTCATCCTTCCA
GATCTACTCTGATCGAACCTACTTCTGGTAACACCGGTATCGGTCTAGCTTTAATCGGCG
CCATCAAAGGTTACAGAACTATCATCACCTTGCCGGAAAAAATGTCTAACGAGAAGTTT
CTGTCCTAAAGGCTCTGGGTGCTGAAATCATCAGAACTCCAACTGCTGCTGCCTGGGATT
CTCCAGAATCACATATTGGTGTTGCTAAGAAGTTGGAAAAGAGATTCCTGGTGCTGTTA
TACTTGACCAATATAACAATATGATGAACCCAGAAGCTCATTACTTTGGTACTGGTCGCG
AAATCCAAAGACAGCTAGAAGACTTGAATTTATTTGATAATCTACGCGCTGTTGTTGCTG
GTGCTGGTACTGGTGGGACTATTAGCGGTATTTCCAAGTACTTGAAAGAACAGAATGATA
AGATCCAAATCGTTGGTGCTGACCCATTCGGTTCAATTTTAGCCCAACCTGAAAACTTGA

ATAAGACTGATATCACTGACTACAAAGTTGAGGGTATTGGTTATGATTTTGTTCCTCAGG
TTTTGGACAGAAAATTAATTGATGTTTGGTATAAGACAGACGACAAGCCTTCTTTCAAAT
ACGCCAGACAATTGATTTCTAACGAAGGTGTCTTGGTGGGTGGTTCTTCCGGTTCTGCCT
TCACTGCGGTTGTGAAATACTGTGAAGACCACCCTGAACTGACTGAAGATGATGTCATTG
TTGCCATATTCCCAGATTCCATCAGGTCGTACCTAACCAAATTCGTCGATGACGAATGGT
TGAAAAAGAACAATTTGTGGGATGATGACGTGTTGGCCCGTTTTGACTCTTCAAAGCTGG
AGGCTTCGACGACAAAATACGCTGATGTGTTTGGTAACGCTACTGTAAAGGATCTTCACT
TGAAACCGGTTGTTTCCGTTAAGGAAACCGCTAAGGTCACTGATGTTATCAAGATATTAA
AAGACAATGGCTTTGACCAATTGCCTGTGTTGACTGAAGACGGCAAGTTGTCTGGTTTAG
TTACTCTCTCTGAGCTTCTAAGAAAACTATCAATCAATAATTCAAACAACGACAACACTA
TAAAGGGTAAATACTTGGACTTCAAGAAATTAAACAATTTCAATGATGTTTCCTCTTACA
ACGAAAATAAATCCGGTAAGAAGAAGTTTATTAAATTCGATGAAAACTCAAAGCTATCTG
ACTTGAATCGTTTCTTTGAAAAAAACTCATCTGCCGTTATCACTGATGGCTTGAAACCAA
TCCATATCGTTACTAAGATGGATTTACTGAGCTACTTAGCATAA

>YGR155W, 507 aa (SEQ ID NO 182)
MTKSEQQADSRHNVIDLVGNTPLIALKKLPKALGIKPQIYAKLELYNPGGSIKDRIAKSM
VEEAEASGRIHPSRSTLIEPTSGNTGIGLALIGAIKGYRTIITLPEKMSNEKVSVLKALG
AEIIRTPTAAAWDSPESHIGVAKKLEKEIPGAVILDQYNNMMNPEAHYFGTGREIQRQLE
DLNLFDNLRAVVAGAGTGGTISGISKYLKEQNDKIQIVGADPFGSILAQPENLNKTDITD
YKVEGIGYDFVPQVLDRKLIDVWYKTDDKPSFKYARQLISNEGVLVGGSSGSAFTAVVKY
CEDHPELTEDDVIVAIFPDSIRSYLTKFVDDEWLKKNNLWDDDVLARFDSSKLEASTTKY
ADVFGNATVKDLHLKPVVSVKETAKVTDVIKILKDNGFDQLPVLTEDGKLSGLVTLSELL
RKLSINNSNNDNTIKGKYLDFKKLNNFNDVSSYNENKSGKKKFIKFDENSKLSDLNRFFE
KNSSAVITDGLKPIHIVTKMDLLSYLA

>YHR095W, 935 bp, CDS: 501-935 (SEQ ID NO 207)
GACACCTTTTCCGGTGTTTGGAGGGGCAACGGCGGGTTGCACTTGACTTTCACTTAAGTT
GTCGTGAAAACTTTCATTTTTACCTTCTGGAGTATTCATGGCCTTTGAACGACCAGATTC
CAATTCATATGAGTTGGATGAATTGGATTTCTGAGGAGATATTAGATCGGGAGTTGAATT
CATGATTTTACGTATATCAACTAGTTGACGATTATGATATCTTTATAGATTTTAAGGTGG
GGAAAGAACATGAGACCCCAGATGGAATTGATTATGGGGACATTGTTGCCTTTATATATA
ATTTCAATATACTAATTCAAATGATTAAAAACGTGAGGGGGACACGCAACTTCGGGTGTT
AAGAAATATTTTGCTACATTAGATAATGGTGGAGTTTCCTGGCTTGTCGGATAAAAGCCA
TCAAATGTCGCAGCAGCTCATGTTTACGTTTGCTGTCTTCTGCCCACGTCATATGAGTGG
TATTCTTCTATCAGCACTTGATGAATATTCTTTTTCTCATATATCTGAAAGACAAAAGAT
CGGCACGGCAATGCCCTGCAGCATTTCTTCCTAGTTTTTCCGAATTTCCATTACGTATTG
GATCTTGTGCGCATATTTGTCAGTCCTTCACGGAAAAAAAAAAGAGCACTGGGTCACTT
CGGAAAAACTTTTGACTCAATGCAACAGTGTCATAATCCTTTGCGCTGTCTCTTTGAAGA
AAAATCAGGAGTGCAAGATATCGATTAATTCCTTGGAAGTTATGATGGTTAGTCTTAGTT
TAACTCTCTTGAAGAAGGGTTTTTTCAGTTGGTCAACACTCTTTAGAGGTAAAAAAAAAA
AAAAAAAAAAAAAAAGAGAATTCTTCATGTAATTTACCATGATTCTACGTTTTTGCAAG
CAAAAATGAAGATAATCCGAGCGCATGCGAAGTAG

>YHR095W, 144 aa (SEQ ID NO 208)
MNILFLIYLKDKRSARQCPAAFLPSFSEFPLRIGSCAHICQSFTEKKKEHWVTSEKLLTQ
CNSVIILCAVSLKKNQECKISINSLEVMMVSLSLTLLKKGFFSWSTLFRGKKKKKKKKKR
ILHVIYHDSTFLQAKMKIIRAHAK

>YHR138C, 845 bp, CDS: 501-845 (SEQ ID NO 209)
CTACGAAAATAAGCAAAAATAAATAAAATAAAAACAAAAACAAAAACAAAAACAAAAAC
AAAAACAAAAACAAAAACACATATTGTTATGATGACTGGACGAAAGAAAGATCGTCGTTA
CTTTCCTAATTGTTTGTCTTCAGTACAGTTATTATCAGTGTTCTCTTTCTTTTTTATTGT
ACTATGTGATGTTACTGATACATCACGCGCTTCCTTTATGTTTTCTTTTTTTATGTTCGT
TACAGGATTTATAGTTTTTACAGTATATTGACTTCAATAATTTCTAATATTCAGTTCCTA
TTAAATTTGATTATTCCGATTAGATCGGTCGGCGCTACCAAAAAGAGGCGAAGAAAGAG

```
GAAAACGCAAGTGGATAAAGGGGTGGGGGGCAAAAGTATTTAAGAAAAAGCGATGCGATG
GAGAGAACAAATGGATAAGTTGCGTTTCCTCGTTATATTACAACATTTAAATCTATTGTG
TAACAGACTATAGCATATATATGAAGGCCAGTTACTTAGTTTTGATTTTCATTAGCATAT
TCTCCATGGCACAGGCATCTTCCTTATCATCATACATCGTAACTTTCCCCAAGACGGATA
ATATGGCTACGGACCAGAATAGCATTATTGAAGATGTCAAAAAATATGTGGTGGACATAG
GGGGTAAAATAACACACGAATATAGCTTGATAAAGGGCTTTACAGTGGACTTACCTGATA
GCGACCAAATTTTGGACGGTCTGAAAGAACGTTTGAGCTATATTGAAAGCGAGTACGGTG
CTAAATGCAATTTGGAAAAGGATTCAGAAGTTCATGCTCTAAACCGTGACCATTTAGTTG
CTTAG
```

>YHR138C, 114 aa (SEQ ID NO 210)
MKASYLVLIFISIFSMAQASSLSSYIVTFPKTDNMATDQNSIIEDVKKYVVDIGGKITHE
YSLIKGFTVDLPDSDQILDGLKERLSYIESEYGAKCNLEKDSEVHALNRDHLVA

>YHR179W, 1703 bp, CDS: 501-1703 (SEQ ID NO 215)
```
ATATCTTACGTAATGAACTTCCGTAATGAACTTCCGTAATTCAAGATCTCTTAGCATCTC
TTGTTCAATCTTCAGACTCTACTAAGTGTTCTTACCAACCATTGGATGCTCATTACAAAT
GAATGAATATATTGCACGGAACGGAAGCGGCATGCTTTTTCCGTCTCGTGTGCTTAGTAA
AGCAAAACGGAGTAGAATCGGTAAGAACTTCCTTTTTGGGTTGGAAAATCATTGCCATTG
TTTGGACACCTTTCTTTTTCCGTATTGTTCGAGCACCGCGTTTCTTTTTGGGTACTTGAT
GAGGTAGCAGATTCCTGGAACGTGCTTTCTCGAGGTAACCTGCCTTGTTCCTCCTGGT
GACTTTCTAAAATATAAAAGGAAAAGCATATCTCTAGTTTCGAGTTTTTTCTTCATACTT
TATTTCCTTATGTTAAACGGTCCAGATATAGAATAAATCATCATATTAAGCTAAATATAG
ACGATAATATAGTATCGATAATGCCATTTGTTAAGGACTTTAAGCCACAAGCTTTGGGTG
ACACCAACTTATTCAAACCAATCAAAATTGGTAACAATGAACTTCTACACCGTGCTGTCA
TTCCTCCATTGACTAGAATGAGAGCCCAACATCCAGGTAATATTCCAAACAGAGACTGGG
CCGTTGAATACTACGCTCAACGTGCTCAAAGACCAGGAACCTTGATTATCACTGAAGGTA
CCTTTCCCTCTCCACAATCTGGGGGTTACGACAATGCTCCAGGTATCTGGTCCGAAGAAC
AAATTAAAGAATGGACCAAGATTTTCAAGGCTATTCATGAGAATAAATCGTTCGCATGGG
TCCAATTATGGGTTCTAGGTTGGGCTGCTTTCCCAGACACCCTTGCTAGGGATGGTTTGC
GTTACGACTCCGCTTCTGACAACGTGTATATGAATGCAGAACAAGAAGAAAAGGCTAAGA
AGGCTAACAACCCACAACACAGTATAACAAAGGATGAAATTAAGCAATACGTCAAAGAAT
ACGTCCAAGCTGCCAAAAACTCCATTGCTGCTGGTGCCGATGGTGTTGAAATCCACAGCG
CTAACGGTTACTTGTTGAACCAGTTCTTGGACCCACACTCCAATAACAGAACCGATGAGT
ATGGTGGATCCATCGAAAACAGAGCCCGTTTCACCTTGGAAGTGGTTGATGCAGTTGTCG
ATGCTATTGGCCCTGAAAAAGTCGGTTTGAGATTGTCTCCATATGGTGTCTTCAACAGTA
TGTCTGGTGGTGCTGAAACCGGTATTGTTGCTCAATATGCTTATGTCTTAGGTGAACTAG
AAAGAAGAGCTAAAGCTGGCAAGCGTTTGGCTTTCGTCCATCTAGTTGAACCTCGTGTCA
CCAACCCATTTTTAACTGAAGGTGAAGGTGAATACAATGGAGGTAGCAACAAATTTGCTT
ATTCTATCTGGAAGGGCCCAATTATTAGAGCTGGTAACTTTGCTCTGCACCCAGAAGTTG
TCAGAGAAGAGGTGAAGGATCCTAGAACATTGATCGGTTACGGTAGATTTTTTATCTCTA
ATCCAGATTTGGTTGATCGTTTGGAAAAAGGGTTACCATTAAACAAATATGACAGAGACA
CTTTCTACAAAATGTCAGCTGAGGGATACATTGACTACCCTACGTACGAAGAAGCTCTAA
AACTCGGTTGGGACAAAAATTAA
```

>YHR179W, 400 aa (SEQ ID NO 216)
MPFVKDFKPQALGDTNLFKPIKIGNNELLHRAVIPPLTRMRAQHPGNIPNRDWAVEYYAQ
RAQRPGTLIITEGTFPSPQSGGYDNAPGIWSEEQIKEWTKIFKAIHENKSFAWVQLWVLG
WAAFPDTLARDGLRYDSASDNVYMNAEQEEKAKKANNPQHSITKDEIKQYVKEYVQAAKN
SIAAGADGVEIHSANGYLLNQFLDPHSNNRTDEYGGSIENRARFTLEVVDAVVDAIGPEK
VGLRLSPYGVFNSMSGGAETGIVAQYAYVLGELERRAKAGKRLAFVHLVEPRVTNPFLTE
GEGEYNGGSNKFAYSIWKGPIIRAGNFALHPEVVREEVKDPRTLIGYGRFFISNPDLVDR
LEKGLPLNKYDRDTFYKMSAEGYIDYPTYEEALKLGWDKN

>YIL074C, 1910 bp, CDS: 501-1910 (SEQ ID NO 219)
TGGGAGTCTTTAGCAAGTTCGGCAAATATCGATATCAATAGTATTGCTAAATAAACCTTT

TTTATTCCATTTACTGTCGTTTATACTGGCTGACCCTTAATTCCCTAGCAATCTTTGCCT
GCACCCGTACCAGGAAGCGTGATAGAATCGGTAGCTACAAAATTTTTAGCATAGTTAATA
AGTGCTATTGTTTTTCATAATGTCACGTGCACTATCAATAATATTACACTCTTGTTCTTG
CCAAATATACACAAAATGCCACATTTTTTTCTTTACACCGAAGAATTTGGCCGTCAGCCG
GACAGCGCTCAGATTAATTGTGGGCTAGATTCTTCACGCTGGAAACGAGTCACCGTTATG
AAAACTAATGGAATCTCCCAGGTTTAATACATAAGAAGGTTACGAGCTACTACATTAAAA
AATACTTTGTCTGTTTTAGCTGTAGATTATTGTAACATTAAAAAGTAACAAACACTGATT
TCGGGTATTTCCTCCCTAACATGTCTTATTCAGCTGCCGATAATTTACAAGATTCATTCC
AACGTGCCATGAACTTTCTGGCTCTCCTGGTGCAGTCTCAACCTCACCAACTCAGTCAT
TTATGAACACACTACCTCGTCGTGTAAGCATTACAAAGCAACCAAAGGCTTTAAAACCTT
TTTCTACTGGTGACATGAATATTCTACTGTTGGAAAATGTCAATGCAACTGCAATCAAAA
TCTTCAAGGATCAGGGTTACCAAGTAGAGTTCCACAAGTCTTCTCTACCTGAGGATGAAT
TGATTGAAAAAATCAAAGACGTACACGCTATCGGTATAAGATCCAAAACTAGATTGACTG
AAAAAATACTACAGCATGCCAGGAATCTAGTTTGTATTGGTTGTTTTTGCATAGGTACCA
ATCAAGTAGACCTAAAATATGCCGCTAGTAAAGGTATTGCTGTTTTCAATTCGCCATTCT
CCAATTCAAGATCCGTAGCAGAATTGGTAATTGGTGAGATCATTAGTTTAGCAAGACAAT
TAGGTGATAGATCCATTGAACTGCATACAGGTACATGGAATAAAGTCGCTGCTAGGTGTT
GGGAAGTAAGAGGAAAAACTCTCGGTATTATTGGGTATGGTCACATTGGTTCGCAATTAT
CAGTTCTTGCAGAAGCTATGGGCCTGCATGTGCTATACTATGATATCGTGACAATTATGG
CCTTAGGTACTGCCAGACAAGTTTCTACATTAGATGAATTGTTGAATAAATCTGATTTTG
TAACACTACATGTACCAGCTACTCCAGAAACTGAAAAAATGTTATCTGCTCCACAATTCG
CTGCTATGAAGGACGGGCTTATGTTATTAATGCCTCAAGAGGTACTGTCGTGGACATTC
CATCTCTGATCCAAGCCGTCAAGGCCAACAAAATTGCAGGTGCTGCTTTAGATGTTTATC
CACATGAACCAGCTAAGAACGGTGAAGGTTCATTTAACGATGAACTTAACAGCTGGACTT
CTGAGTTGGTTTCATTACCAAATATAATCCTGACACCACATATTGGTGGCTCTACAGAAG
AAGCTCAAAGTTCAATCGGTATTGAGGTGGCTACTGCATTGTCCAAATACATCAATGAAG
GTAACTCTGTCGGTTCTGTGAACTTCCCAGAAGTCAGTTTGAAGTCTTTGGACTACGATC
AAGAGAACACAGTACGTGTCTTGTATATTCATCGTAACGTTCCTGGTGTTTTGAAGACCG
TTAATGATATCTTATCCGATCATAATATCGAGAAACAGTTTTCTGATTCTCACGGCGAGA
TCGCTTATCTAATGGCAGACATCTCTTCTGTTAATCAAAGTGAAATCAAGGATATATATG
AAAAGTTGAACCAAACTTCTGCCAAAGTTTCCATCAGGTTATTATACTAA

>YIL074C, 469 aa (SEQ ID NO 220)
MSYSAADNLQDSFQRAMNFSGSPGAVSTSPTQSFMNTLPRRVSITKQPKALKPFSTGDMN
ILLLENVNATAIKIFKDQGYQVEFHKSSLPEDELIEKIKDVHAIGIRSKTRLTEKILQHA
RNLVCIGCFCIGTNQVDLKYAASKGIAVFNSPFSNSRSVAELVIGEIISLARQLGDRSIE
LHTGTWNKVAARCWEVRGKTLGIIGYHIGSQLSVLAEAMGLHVLYYDIVTIMALGTARQ
VSTLDELLNKSDFVTLHVPATPETEKMLSAPQFAAMKDGAYVINASRGTVVDIPSLIQAV
KANKIAGAALDVYPHEPAKNGEGSFNDELNSWTSELVSLPNIILTPHIGGSTEEAQSSIG
IEVATALSKYINEGNSVGSVNFPEVSLKSLDYDQENTVRVLYIHRNVPGVLKTVNDILSD
HNIEKQFSDSHGEIAYLMADISSVNQSEIKDIYEKLNQTSAKVSIRLLY

>YIR037W, 992 bp, CDS: 501-992 (SEQ ID NO 221)
GTTTTCCATGCTTTTGCCGGATTTCCTCCACCAACGCTTCCATTCGAGACCTGTCCGTGA
TGTCGAGGACACGATAGACAAATTTGTCTGCACCGTATTCTCTTTGCAAAGACTGCAGAC
CAGCTTCCGTTCTTGCTACGCCGTAGACGATGCATTCATCGTCCTCTTCGATAACAGTTT
TCACCAATTGCAGGCCAATCCCACGGGAGGCACCTGTAATCAAAATAACCTTGCCCATAT
CCCTTCTTTGACAGATTATAAGTTGTTTCTCTTGTTGCTGTTCGCGACAGCCCTTATTTC
CTGTATTCCTTCTTCTTTTTCTGCATTATCGTTTTAGCCACTTTACGAAAAAGGTCAAA
AAGTGAAAAAAGAGGGAAAAAACCATGAGGAACAGTATGCTCCCTTAATATCGGAAAAG
CAATAGTAATAAAAACAGCATCAGAGCTTTCCACGTCTCTCTCTTCCAAGCTGTCATCTC
GTAAAGTATTCAAGTTTATCATGTCAGAATTCTATAAGCTAGCACCTGTTGACAAGAAAG
GCCAACCATTCCCCTTCGACCAATTAAAGGGAAAAGTGGTGCTTATCGTTAATGTTGCCT
CCAAATGTGGATTCACTCCTCAATACAAAGAACTAGAGGCCTTGTACAAACGTTATAAGG
ACGAAGGATTTACCATCATCGGGTTCCCATGCAACCAGTTTGGCCACCAAGAACCTGGCT
CTGATGAAGAAATTGCCCAGTTCTGCCAACTGAACTATGGCGTGACTTTCCCCATTATGA

AAAAAATTGACGTTAATGGTGGCAATGAGGACCCTGTTTACAAGTTTTTGAAGAGCCAAA
AATCCGGTATGTTGGGCTTGAGAGGTATCAAATGGAATTTTGAAAAATTCTTAGTCGATA
AAAAGGGTAAAGTGTACGAAAGATACTCTTCACTAACCAAACCTTCTTCGTTGTCCGAAA
CCATCGAAGAACTTTTGAAAGAGGTGGAATAG

>YIR037W, 163 aa (SEQ ID NO 222)
MSEFYKLAPVDKKGQPFPFDQLKGKVVLIVNVASKCGFTPQYKELEALYKRYKDEGFTII
GFPCNQFGHQEPGSDEEIAQFCQLNYGVTFPIMKKIDVNGGNEDPVYKFLKSQKSGMLGL
RGIKWNFEKFLVDKKGKVYERYSSLTKPSSLSETIEELLKEVE

>YJL161W, 1043 bp, CDS: 501-1043 (SEQ ID NO 229)
TCATAAAGTCTGGCGGCGTATTCCTTGCACAATTTTCATATCTTCCCATATGAATACCTG
TTAGTCCGTATCACCAAGTGTAAACTGTTCTTTACAATGAGAACATCTAGAGTCTTTCTG
ATATGCGTAACTTCTGCCTCATTAATTTAAAAATTTCTTCATAGTAAATAGCTTATTTGC
TTGGAGCAGATGATCGACATGTATTTTTAGGAACATAAACTGCCTAAATATAATAGATCA
GCCTAAAAATAAGAATGCCAATCAACAAAGTTGTATTTCCTATCTTCGATATTCGCAGT
CCACCATTCAGACCTCTGGTGAGATAGTTTGCCTGCTTTTGCTCCCTTCCAAAGTGCTGA
TAAAAACCTCCGTGATTTTTGAATACTCCCCTGAATGTCTATTTTAAGTATATTATAAA
ATTAGTTTAAGTTGGTGCGGATAACGAAAACTTGATGCAAGGTAAATAAATCAAGTATAT
CATAGAGTTCTTTCATTCATATGCTATACACAAGGTTGTTACGTCACAACTCACAATTCA
CCAAGTTTTCAGGCACATCGCCCAATCTTGGCTCAAAACCTTTATTTTCGAAGGGTAATT
TGTACACTAGTCTTTTAGTGACAACACTGTATGGGACAGGTCTGGCATGCCTATATCTAG
AATCAAATAGCTTGAATAAGTCCAAGAGCAAGAAGATCCCCATGCCATCGCAGAAGACG
ACATTGTAAATATAGTCCATGACGCTCCCAATAGAATATTCAAGCCAGCACTTGATACCT
ATCAAGAGAAAGAGCTTGACTTACAAAAGAGTGACCTCCATAAAGTACTTCATTCTTTGA
CGTACAGTGATGTCTCTCAATTTTCGATTGTTTGGGGGTTTCTCATTCAACTTTCGAGCC
TAATAGGCAATTCCACCTTAGGCAAAAAATCCATTCTTTATAAGGGAAGTGTCGTTAGTG
TTTTAGGGTTCCCACCGTTGATTTATATGGCACTTAAACTTAGGATGAAACAGCTGGAAA
AAGCTGGAGTGCGCTTTGAGTAA

>YJL161W, 180 aa (SEQ ID NO 230)
MLYTRLLRHNSQFTKFSGTSPNLGSKPLFSKGNLYTSLLVTTLYGTGLACLYLESNSLNK
SKEQEDPHAIAEDDIVNIVHDAPNRIFKPALDTYQEKELDLQKSDLHKVLHSLTYSDVSQ
FSIVWGFLIQLSSLIGNSTLGKKSILYKGSVVSVLGFPPLIYMALKLRMKQLEKAGVRFE

>YJR096W, 1349 bp, CDS: 501-1349 (SEQ ID NO 233)
GTATATTCAAGAAGAATGACACACCAAAGCCAAAGCCATTAAAGTAGATGATGAACAATG
GGACTACAAAATGAAATAAAGAAAAAATAGAAATAGGCTAGAAGATCAATTATTAATCGC
CCTATTCTTCCTTATTACCTACACAAAATAAAGCAGCAACATAAGAAACAAAAACAAAAT
GAAAACAAACCAAATAAATCTATGTAAGCATACTCATTTCAATTTGATATTCATTACTTG
ACTTTTTTGTCCTTATTTGAGGCTCCATAAGCGCGCCATTTTTCCCTACTCCCTTTTTTC
GTAAATAGTAATAATGTGCTGAAAAGAACAATGAAGTAGTTATCATACATATTCCGTCGT
GTCGATATGAGGGGAGGTGTCTCTTTCTTTCATCCCTTGTCGCAACCTCCAATATATAAG
AGCATAAGCAACTGATCTTACTTTAGTAATTAACTTAGCATACCTAGCCCGAAGGAAGAA
AAAAAATTCACCTCAACAACATGGTTCCTAAGTTTTACAAACTTTCAAACGGCTTCAAAA
TCCCAAGCATTGCTTTGGAACCTACGATATTCCAAGATCGCAAACAGCCGAAATTGTGT
ATGAAGGTGTCAAGTGCGGCTACCGTCATTTCGATACTGCTGTTCTTTATGGTAATGAGA
AGGAAGTTGGCGATGGTATCATTAAATGGTTGAACGAAGATCCAGGGAACCATAAACGTG
AGGAAATCTTCTACACTACTAAATTATGGAATTCGCAAAACGGATATAAAAGAGCTAAAG
CTGCCATTCGGCAATGTTTGAATGAAGTCTCGGGCTTGCAATACATCGATCTTCTTTTGA
TTCATTCGCCACTGGAAGGTTCTAAATTAAGGTTGGAAACTTGGCGCGCCATGCAAGAAG
CGGTTGATGAAGGATTGGTTAAGTCTATAGGGGTTTCCAACTATGGGAAAAGCACATTG
ATGAACTTTTGAACTGGCCAGAACTGAAGCACAAGCCAGTGGTCAACCAAATCGAGATAT
CACCTTGGATTATGAGACAAGAATTAGCAGATTACTGTAAATCTAAAGGTCTCGTCGTCG
AAGCCTTTGCCCCATTGTGTCACGGCTACAAAATGACTAATCCAGATTTATTAAAAGTTT
GCAAAGAGGTGGACCGTAATCCAGGTCAAGTTTTGATTCGTTGGTCTTTACAACACGGTT

ATTTACCACTACCGAAGACTAAAACTGTGAAGAGGTTAGAAGGTAACCTTGCAGCCTACA
ACTTTGAACTGTCAGACGAACAGATGAAATTTCTTGATCATCCTGATGCTTATGAGCCTA
CCGATTGGGAATGCACAGACGCGCCATAA

>YJR096W, 282 aa (SEQ ID NO 234)
MVPKFYKLSNGFKIPSIALGTYDIPRSQTAEIVYEGVKCGYRHFDTAVLYGNEKEVGDGI
IKWLNEDPGNHKREEIFYTTKLWNSQNGYKRAKAAIRQCLNEVSGLQYIDLLLIHSPLEG
SKLRLETWRAMQEAVDEGLVKSIGVSNYGKKHIDELLNWPELKHKPVVNQIEISPWIMRQ
ELADYCKSKGLVVEAFAPLCHGYKMTNPDLLKVCKEVDRNPGQVLIRWSLQHGYLPLPKT
KTVKRLEGNLAAYNFELSDEQMKFLDHPDAYEPTDWECTDAP

>YKL065C, 1121 bp, CDS: 501-1121 (SEQ ID NO 241)
CTGGGCTAGGTTTCACATATCAAAAGAAGTTATGGCTTATGTGCTCTTTCTAAGTTTGA
CTTTATGCCAAAAATTTCTCCGTAGATCGCCGCCCGTTGAAGCAGCAGAATATTTAAGT
GCGCCATAAAAACCTAGATAGAAAAGAAGGGAGAGAACATAAACGCAGAACACCACTACT
TTTAAGGCGTACGCAAACTGTTGGGCTTATCTATATTGTACTATCTACCTACTTGCAACG
TCTTTTACCTCCTCGATACGTACTGCTTATGCCCTGAACAATTTACATGTAACCCGCAGC
TGCATGCTATATCACAGGATACGTTAACATAAAGGGGCGCTACTAAACCCTCTGGCGCA
GTGCAAAAATAGAAATATATGCCAAGTGGGACCTTGTATAGTTTCTGGTTTAAAGCTATT
CGTTCATTGCAACGCTCCTTTCTGCTATCCTTTCGCAAAGTGGCAAGTACTGAAAACCGA
GAAGAATAAATAATATTGCGATGAGTTTATACTTTACGACATTATTTTTATTGCTCACTG
TTGAGGTGGTAATGCTCTTCATCTTCGTTTTGCCTTTGCCATTCCGGATCCGTAGGGGTA
TTTTTAGCACCTATAACCAATTGACAGCGAAGCAGCAAATAAAAACTATAATCTTTATAA
CGGGTTGTCTTGTTGGCCTGTTGTTTATTGATTCATGGAAAAGGTCTCAAATTCGTGTTT
CATTATACCACAACGACAACAGTGGCTCAATCGGGTCATCTGCTGTAACTCCAATACAGG
CACTAGCATCAAGAGCGTACAATCAAAGAAATATGTATATTTCCGGGTTCATATTGTACT
TTTCTATCTGTATCCCAACTGTCATGTCTATTGTCAAGAGACTGGTGAAATACCAAGGCT
TAATCAACGAACAAGAAAAGCAAAAATTGAACAAACCTTCCTCAAACAGCAAGAAAGACT
CAAATGAAGCTGATTCCACCAAACTTCAAGAGGAACTAAGGAAAAAGCAAATTTCTCTGG
AGGGCCTACAAAAGCAAGTCAAAAACCTGGAGAAATATTTTGATGAGAAGAATCAACCTG
GAAATGTAGCAGCTGCTGAAGCTTCCAAGAAAGGAAACTAA

>YKL065C, 206 aa (SEQ ID NO 242)
MSLYFTTLFLLLTVEVVMLFIFVLPLPFRIRRGIFSTYNQLTAKQQIKTIIFITGCLVGL
LFIDSWKRSQIRVSLYHNDNSGSIGSSAVTPIQALASRAYNQRNMYISGFILYFSICIPT
VMSIVKRLVKYQGLINEQEKQKLNKPSSNSKKDSNEADSTKLQEELRKKQISLEGLQKQV
KNLEKYFDEKNQPGNVAAAEASKKGN

>YKL196C, 1103 bp, CDS: 501-1103 (SEQ ID NO 253)
AAAGAGGCTTCCTATTAGGAGCAATAAAATATAAAGCACCAGCCATAGAAAGAATCCCCA
TTATAAAGCCCGCTGTTTTTTCCTGATTGGAGTTCCTACCGAACTGAGGGGAGGACGCCA
TGAGACGTCTTGTTTGGTGTCGGCATAACCCCCTTGCCACTTGAATTGACGGCCTGTTTC
TGCACGCATTCCTGACGACTAAGTTGCGAAGCATTTTACTGATAATATACACTCTTTGGA
TCGAGCCTACTTCCAGTTGGTAATTGGTGTTCCACAATTTCAGCATTATATGTTTTTAAA
CCAAAATTCGGCTCCTTTTCCCTTTTTTTCTTATTGGGTGGCGTGCCGTACAGAACGATT
GGCTTGGTGTGAAATCAAGAGCAAGCACAATAGATATCAACATGAACAATATACAAAAGT
CTCTGGCACAGTTTGACTGCGTTAGACCAGGCTAGGGCATTTCTGAAGCTTTACGTATCA
CTAGAGAAGTTATTTTGGCAATGAGAATCTACTACATCGGTGTATTTCGCTCTGGAGGAG
AAAAGGCTCTAGAGTTGAGTGAAGTTAAAGACTTGTCACAATTTGGTTTCTTTGAAAGGT
CTAGTGTTGGCCAGTTTATGACTTTTTTTGCTGAAACGGTCGCTTCTAGAACTGGTGCAG
GACAAAGACAAAGTATAGAAGAAGGCAACTATATTGGCCACGTTTATGCCAGGAGTGAGG
GCATATGTGGTGTTTTGATCACCGACAAAGAATATCCTGTCAGACCAGCATACACACTAT
TAAACAAAATATTGGATGAATATTTAGTCGCACATCCTAAGGAAGAGTGGGCAGATGTGA
CTGAGACCAATGATGCATTGAAAATGAAGCAACTGGACACTTACATTAGCAAATATCAAG
ATCCTTCACAGGCTGACGCTATCATGAAAGTTCAACAAGAACTGGATGAGACGAAAATCG
TTTTGCACAAAACGATTGAGAATGTTTTACAAAGAGGTGAAAAGTTGGATAATTTGGTGG

ACAAATCGGAGTCATTAACGGCAAGTTCCAAAATGTTTTATAAGCAAGCTAAAAAATCCA
ATTCGTGTTGCATCATCATGTAG

>YKL196C, 200 aa (SEQ ID NO 254)
MRIYYIGVFRSGGEKALELSEVKDLSQFGFFERSSVGQFMTFFAETVASRTGAGQRQSIE
EGNYIGHVYARSEGICGVLITDKEYPVRPAYTLLNKILDEYLVAHPKEEWADVTETNDAL
KMKQLDTYISKYQDPSQADAIMKVQQELDETKIVLHKTIENVLQRGEKLDNLVDKSESLT
ASSKMFYKQAKKSNSCCIIM

>YKR076W, 1613 bp, CDS: 501-1613 (SEQ ID NO 259)
TAAATAGTTGAGGCTTTTCCTGCATTCTGTCAAGAAGGGTATGTGTATGAACATGCAAAT
GACACTGTAAAATGATTCATTACCCTGATTATGGAGTGATTTTCTTTCCTTTTTTTTTTT
ACATTTAGTTTCATTATTATGCAAATTAGAGGGTATACAGTTGAGATTTTAACACTTTGA
ATTAAAAAGTGTTACAGAGGAAACCGACGCAAAAGGCTTGGTGACGCAAACTTTTCCATC
TTTATTTCACCTCTTCAGACGGTCCTAAGACCTTTTGAACGTATCAATATAGTTTTATCA
TCTGTTCTCTGTTGTTCTCCGTTACTAAGATATTAGTCAGCTCTTGAAATTTCACACCCC
TATTTATTTGTCTTAGCGTCCAACCCCTCTCAACCCTTTTCCATTTCTTGTATAAAGGTA
GTTAATTAGGTAACGCTGCTCTTACCATCACTACAGTGCTTACGAGAATTTACCCAAACC
CTGCGCAAGATAAATAAGAAATGTCGAAACAGTGGGCGAGTGGTACAAACGGAGCTTTCA
AAAGACAGGTTTCGTCCTTCAGAGAAACAATCTCTAAGCAACACCCAATTTATAAGCCAG
CAAAGGGAAGATATTGGTTGTATGTTTCACTTGCATGCCCATGGGCCCATAGAACACTAA
TTACGAGGGCTTTGAAGGGATTAACCTCTGTTATAGGATGTAGCGTAGTCCATTGGCACC
TTGACGAGAAAGGATGGAGATTTTTGGACATGGAAAAGCAATTGGAGGACAGTGAAGATT
TTTTGGAACATTGGCACGATGTTGCAGGTGGTATTAGAACTGCTAAAGAGGATTCCAGCA
AGAGCTTCGCCGAGATCAAGAATGACAGTCAAAGATTCATGGTTGATGCTACCAATGAGC
CTCACTATGGATACAAGAGAATCAGTGACTTATATTACAAGAGCGATCCTCAATACTCGG
CAAGGTTCACCGTCCCAGTCCTGTGGGACTTAGAAACCCAAACAATTGTTAACAACGAAA
GTAGCGAAATTATAAGGATTTTGAACTCTAGTGCGTTCGATGAATTTGTCGACGACGATC
ACAAGAAAACGGACCTTGTTCCTGCTCAGTTGAAAACACAGATCGATGACTTCAATTCTT
GGGTTTACGACAGCATCAACAATGGTGTATACAAGACCGGATTCGCAGAGAAAGCAGAAG
TTTACGAAAGTGAAGTCAACAACGTATTTGAACATTTGGACAAAGTGGAGAAAATCCTGA
GTGACAAATATTCCAAATTGAAGGCCAAATACGGTGAAGAAGATAGACAAAAAATCTTGG
GTGAGTTCTTCACTGTGGGTGATCAATTAACAGAAGCTGACATTAGATTGTATACTACCG
TCATAAGATTCGATCCTGTGTACGTCCAACATTTCAAATGCAATTTTACCTCTATTAGAG
CCGGATATCCATTTATTCATTTGTGGGTAAGAAATTTATACTGGAATTATGATGCCTTCA
GGTACACAACAGATTTTGACCATATCAAGTTACACTACACGCGTTCCCACACAAGGATCA
ACCCCTTGGGAATTACGCCCCTGGGACCCAAGCCAGATATTCGTCCTTTATAA

>YKR076W, 370 aa (SEQ ID NO 260)
MSKQWASGTNGAFKRQVSSFRETISKQHPIYKPAKGRYWLYVSLACPWAHRTLITRALKG
LTSVIGCSVVHWHLDEKGWRFLDMEKQLEDSEDFLEHWHDVAGGIRTAKEDSSKSFAEIK
NDSQRFMVDATNEPHYGYKRISDLYYKSDPQYSARFTVPVLWDLETQTIVNNESSEIIRI
LNSSAFDEFVDDDHKKTDLVPAQLKTQIDDFNSWVYDSINNGVYKTGFAEKAEVYESEVN
NVFEHLDKVEKILSDKYSKLKAKYGEEDRQKILGEFFTVGDQLTEADIRLYTTVIRFDPV
YVQHFKCNFTSIRAGYPFIHLWVRNLYWNYDAFRYTTDFDHIKLHYTRSHTRINPLGITP
LGPKPDIRPL

>YKR092C, 1721 bp, CDS: 501-1721 (SEQ ID NO 261)
TCAAGGATACCTGGTTGATTCTACGTCGTCCTCTTCACTTTGGTTAATTCACCTTTGCCC
TTCACCTTGTGGTGTGCGGGTGTTGCAGTCATTAATGTTCTTTATCGCGAGAGGGGGTCT
ACATAATCTTGTTTTTTCACTCCAATAAGGCAGTTATAGTGAATTTGTTTTATTACAGAA
GGTGTACCCTTCGTTCGAGTTATTTACTCTTGTTTTGTAGTTTGTACATCTCTTTATGT
CTGGATCAAAACGATAATTCGAAGCTTATTGCAATTTAGTTCTCTTACCCATTTCTTTAC
AACGGGCCGAGAAAAGTGGAGTTGGTCCGAGGAAGCTTTGAACGGGAAGAGGAAAAAAC
CTTCCCATCGCTCGAGCATACAATTTTTTTTTTTCAATGCAGGCTGAAAAAAAAAAATT
CACTTGATGATTGAACTCATCGCACTTTTATACAAAGCAAGAAAGAAACCCAAGTCGCAG

TACACTAAGAATACATAGCAATGGCTTCCAAGAAAATTAAAGTTGACGAAGTGCCAAAAT
TAAGTGTTAAGGAGAAGGAGATTGAAGAGAAATCTTCTTCTTCTTCTTCCTCCTCCTCCT
CCTCCTCCTCCTCCTCTTCTTCTTCATCTTCCTCGTCCAGTTCTAGCGGCGAATCTTCAA
GCAGCAGCAGCAGCAGCAGCAGCAGCAGCAGCAGTGACAGCAGTGACAGCAGTGACTCTG
AATCTAGCTCATCATCATCTTCTTCTTCTAGCTCAAGCTCAAGTTCCAGTGACTCTGAAT
CTTCTAGTGAATCCGACTCTAGCTCCAGTGGATCTTCTTCTTCCTCTAGCTCTAGTTCTG
ACGAATCTTCTTCGGAATCCGAATCAGAAGATGAAACCAAGAAAGAGCAAGAGAATCAG
ACAACGAAGATGCTAAGGAGACTAAAAAGGCTAAAACTGAACCAGAAAGCTCTTCCTCAT
CGGAGTCAAGCTCTAGCGGGTCATCGTCATCTTCAGAATCAGAATCAGGTTCGGAATCTG
ATTCTGACTCAAGTTCTAGCTCAAGTAGTTCTTCTGATTCCGAATCAGATTCTGAATCAG
ATTCTCAATCAAGTTCTAGCTCCAGCTCTAGCGACTCTTCGTCTGACTCCGACTCCAGCT
CCAGCGACTCTTCATCTGACTCCGACTCTAGCTCCAGCTCTAGCAGCTCTTCCTCGGATT
CAGATTCGGATTCCGACTCAAGCTCGGACTCAGACTCTTCAGGCTCGTCCGATTCTTCAA
GCTCGTCTGATTCAAGTTCCGACGAATCTACATCTTCTGATTCCTCCGATTCGGATTCCG
ACTCAGACTCTGGTTCTAGCTCTGAATTGGAAACAAAAGAAGCAACTGCAGACGAATCCA
AGGCCGAAGAAACGCCTGCCTCATCTAACGAATCAACTCCATCTGCTTCCAGTTCATCAA
GCGCCAATAAATTGAACATTCCTGCTGGAACCGACGAGATCAAAGAGGGCCAAAGAAAGC
ATTTTTCCAGAGTAGATAGATCGAAGATTAATTTCGAAGCTTGGGAGTTGACAGACAACA
CCTACAAAGGCGCGGCTGGAACATGGGGTGAAAAGGCAAATGAAAAATTAGGTAGAGTAA
GAGGTAAAGATTTCACGAAGAACAAAAATAAAATGAAGAGAGGTTCTTACAGAGGTGGAT
CCATTACATTAGAAAGTGGTTCATACAAATTCCAAGATTAA

>YKR092C, 406 aa (SEQ ID NO 262)
MASKKIKVDEVPKLSVKEKEIEEKSSSSSSSSSSSSSSSSSSSSSSSSSGESSSSSSSSS
SSSSSDSSDSSDSESSSSSSSSSSSSSSSSDSESSSESDSSSSGSSSSSSSSSDESSSES
ESEDETKKRARESDNEDAKETKKAKTEPESSSSSESSSSGSSSSSESESGSESDSDSSSS
SSSSSDSESDSESDSQSSSSSSSSSDSSSDSDSSSSDSSSDSDSSSSSSSSSSDSDSDSDS
SSDSDSSGSSDSSSSDSSSDESTSSDSSDSDSDSDSGSSSELETKEATADESKAEETPA
SSNESTPSASSSSSANKLNIPAGTDEIKEGQRKHFSRVDRSKINFEAWELTDNTYKGAAG
TWGEKANEKLGRVRGKDFTKNKNKMKRGSYRGGSITLESGSYKFQD

>YLR043C, 812 bp, CDS: 501-812 (SEQ ID NO 269)
AGACAAGTCTTTCAACGACAACTCTAAGATCAGAATGATTGAAATCATGTTGCCAGTCTT
CGATGCTCCACAAAACTTGGTTGAACAAGCTAAGTTGACTGCTGCTACCAACGCTAAGCA
ATAAGCGATTTAATCTCTAATTATTAGTTAAAGTTTTATAAGCATTTTTATGTAACGAAA
AATAAATTGGTTCATATTATTACTGCACTGTCACTTACCATGGAAAGACCAGACAAGAAG
TTGCCGACAGTCTGTTGAATTGGCCTGGTTAGGCTTAAGTCTGGGTCCGCTTCTTTACAA
ATTTGGAGAATTTCTCTTAAACGATATGTATATTCTTTTCGTTGGAAAAGATGTCTTCCA
AAAAAAAAACCGATGAATTAGTGGAACCAAGGAAAAAAAAAGAGGTATCCTTGATTAAGG
AACACTGTTTAAACAGTGTGGTTTCCAAAACCCTGAAACTGCATTAGTGTAATAGAAGAC
TAGACACCTCGATACAAATAATGGTTACTCAATTCAAAACTGCCAGCGAATTCGACTCTG
CAATTGCTCAAGACAAGCTAGTTGTCGTAGATTTCTACGCCACTTGGTGCGGTCCATGTA
AAATGATTGCTCCAATGATTGAAAAATTCTCTGAACAATACCCACAAGCTGATTTCTATA
AATTGGATGTCGATGAATTGGGTGATGTTGCACAAAAGAATGAAGTTTCCGCTATGCCAA
CTTTGCTTCTATTCAAGAACGGTAAGGAAGTTGCAAAGGTTGTTGGTGCCAACCCAGCGG
CTATTAAGCAAGCCATTGCTGCTAATGCTTAA

>YLR043C, 103 aa (SEQ ID NO 270)
MVTQFKTASEFDSAIAQDKLVVVDFYATWCGPCKMIAPMIEKFSEQYPQADFYKLDVDEL
GDVAQKNEVSAMPTLLLFKNGKEVAKVVGANPAAIKQAIAANA

>YLR053C, 827 bp, CDS: 501-827 (SEQ ID NO 271)
AACACTGGGGATATTTTGAGATTTACCACTAGTAGATACGGTGGTGTAGATACGTATGAT
TCCATCTTGAGGGACCAATCCACGATCATGGAACTTTTAGATAAACGGTGTGCCTATTCA
CCTCCAGTACTGTTCGATAATGAGGCTAAGAACGTGATCATGATCGCGATTGTTATCAA
GATTACAATCACGACCACCGGAGTCATTAATATTAAAAAAAAAAAATGTGATTGTTAATA

AGGGGTGGGATGCGCGAAATTCTATGCCTACAGTAGAAAGCGGTTGTTGCACAAATGATT
AAATCTTTATCTCCAACTCACAATACTATCGCGATAGATGCATAATATGTGCAGCTTCTA
AACAGCACGGAGTGATGATAAATACGCATATATGTATATATATATGTATGTGCATATGCA
CGTCCTTTTAAAACTCAAAATACAACATTCTTAGTAAATCCTTTTGTTGACACACGTCGG
AACAACTCAGGACGGAGTTAATGGATATGCTTCATAATAAATGTAGTGATGCTATCAAAA
GCACCTCCAATAGCAATTTGAGTAATGAGGTAGACAAACAAAAATTGCAATACGATGACC
TCGGGAACACCGGATTTTCTGAACTATTTGAGATGGAATCTCAAGATAATAATGATAGCA
TAGAGGATTTCTTGTTCTTTAATATAAATTTAACCCAGGAGGTTGAGTTCGAGAACCAAA
GACAATATGAGCACACGAAAAAGACAAAGAAGCATAACCCATTCTATGTACCGTCAGAGG
TAGTGCGAGAGATGGTCAAGAAACACGCATTGAATGGCAGAATATAG

>YLR053C, 108 aa (SEQ ID NO 272)
MDMLHNKCSDAIKSTSNSNLSNEVDKQKLQYDDLGNTGFSELFEMESQDNNDSIEDFLFF
NINLTQEVEFENQRQYEHTKKTKKHNPFYVPSEVVREMVKKHALNGRI

>YLR390W, 839 bp, CDS: 501-839 (SEQ ID NO 291)
GTGAAATTGAGACTGATAGGTGAGAGGTGAACCAATTGAGTGAGGAGTGGTTTAGTTACA
AATGCAGAAGAAGAAGCTAAAAGAGATACGCCCATACAGAGCAATATCAAAATGAGCAAG
AATGAGGTCTTCCGAATGGTTGGTTCTGACTTACTATTTGATTTCACTTTCTCTGATTCA
TTCAGGAAGAAAAGGGCGAAGTCCTCGAAATGAAAATTTCAACATCATTAACAGACCGGC
GCGCGCCTTTACAATTTAGTATGTACGCCACCAATAAAAGCTGCTTAAACAATAAGCTAG
AAAGCCCAAAGGGTGTTAAATAGTACAGCGAACCCTTCAGCAACGGTACATCAACAACCC
CTTGAAAAGAATAGAGACAATACAGCTACAGTCATCCCCTTCTCTTGTATTTTTGGCCAC
AATTGATTGTATTACATCATATTTTGCCTGTGCGCTTCTTCTATCTTTTCCGCATAAACT
AGGGGAAACGCGATGAAGAAATGGATTGGCTGAAAAATACAACAATTGTAGTGTTATTCA
GTCATTCAACTGACAAAAGTAACAAACACAAGAAACGTCAAGTCCAGTGCAATATGCGAA
AGAACACTTTAGATATGGTCACTATAGGTATCGCATGCCTTGTGGGAGTCTACACGGGCA
CGAGATTTTTCGAGCCCATTGTTATCGATAGATTGCGTAAGGATGGAAACTTGAGAACGG
ACATTCCATCCCAGAATACGACGAGGACGGAAATCTGTTAAAGGTCACGCCGTCTTTAT
CATCCACACCAGCTGCACCACCTACACCACCTACACCTCCTACTCCACCACAACAGTAA

>YLR390W, 112 aa (SEQ ID NO 292)
MDWLKNTTIVVLFSHSTDKSNKHKKRQVQCNMRKNTLDMVTIGIACLVGVYTGTRFFEPI
VIDRLRKDGNLRTDIPIPEYDEDGNLLKVTPSLSSTPAAPPTPPTPPTPPQQ

>YMR251W, 1601 bp, CDS: 501-1601 (SEQ ID NO 315)
ACTCCAGAGCGCAAGAGTTCGTTCATCTACGAAATGTTGCTGGCATTGGCATCTCCACAA
GATGACATCCCAACGCCGGATGAAATCGAAAGAAAAATAAGCTAAAGGAAACAACAACG
AGAAACTATAGAGGAACATGTTGAGTTGAAAAGGTCATCCAATATACCGCCCCCTATATG
TATGTACCTTTACCTTTTATTTAAGTACTAGTGCTGTTTAGTTAGGTTATGTGAAGGCAC
GGGTTTTGTCTTTTTTTTTTTTTTTTTTTACTATTACTTTCTTTTTCAAGCTTTTAAGCG
CCGAAATGATATTTAAGGGAAGATGACTAAAGGGACAGCGACGAGGATTCAGCCTGGACA
GTGATAGAAAAGTTATGCGGGAATACGTATATATAGTTGTATAAATTGTGGTTATAGAAC
ATCGCAGCGCCTTTAAATATATTGTCTTTTATTTCAATCTTATTCCATCTCTCTCTTGCA
ACCACGGCAAAGCTGGAGCTATGTCTGAAAAATCAGCTAGCAATAACAAAGCTGAATTCA
AAAGGCAGTCATCGCCATTCAGAGAAATCATCTCTGCGGATCACCCAATTTATAAACCTG
CTAAGGGAAGGTACTGGCTGTATGTGGCGCTACCATGCCCATGGGCACAAAGAACCTTGA
TCACCAGGGCCCTGAAAGGGCTAGCGCCTATAATCGGGTGCAGTGTAGCGCATTGGCACC
TGGATGACAAAGGCTGGCGATTCCTTGAAGAAGGAGATGGGAAAACCAATGAAAGGCACT
GGTTTGACATTGCAGGCGGAATTAGCTCAGTAAATTTAAATACCAGTACTCCTGTGGCTA
ACATACCCAATAACGCGCATCGGTTGTTGGTCGACGGAACAGATGAACCGCATTACGGGT
ACAAGAGACTAAGCGACTTCTATTTCAAAACAAAGCCAGACTATAAGGGAAGATTCACCG
TACCTGTTCTTTGGGACTTGGAAACATGCACTATAGTAAACAATGAAAGCAGTGATATCA
TCGGAATTATGAATTCCGCTGCGTTTGATGAGTTTGTCGGCGAAGAATACCGTCAAGTCC
GTCTGGTACCTCGGTCTCTAGAGGCACAGATTACAGAGTTCAACTCTTGGGTGTACGATA
AAATCAACAACGGTGTATACAAGGCCGGTTTTGCAGAATGTGCAGAGGTATACGAGAGGG

```
AGGTAACAAGCCTTTTTTCAATATCTTGACAAATTGGAAAATCTTCTGGACAAGAAGTACA
CAGATTTGGAGGCGGAGTATGGTAAGAACAACAAGGACAAGATACTAGATCGCTACTTTG
CCATCGGAGACACTCTGACCGAGGCGGACGTGAGACTCTACCCAACGATAGTAAGGTTCG
ACGTGGTATACCATCAACACTTCAAATGCAATCTGGCCACCATCAGAGATGATTATTCCC
GTATACACACGTGGCTCAAGAATATATACTGGCGCCACGAAGCCTTCCAGCGCACAACGG
ACTTTACCCACATAAAACTCGGATATACTCGCTCGCAGCCACGGGTCAACCCGATTGGGA
TCACCCCACTGGGGCCCAAGCCTGATATCCGACCTCCATGA
```

\>YMR251W, 366 aa (SEQ ID NO 316)
```
MSEKSASNNKAEFKRQSSPFREIISADHPIYKPAKGRYWLYVALPCPWAQRTLITRALKG
LAPIIGCSVAHWHLDDKGWRFLEEGDGKTNERHWFDIAGGISSVNLNTSTPVANIPNNAH
RLLVDGTDEPHYGYKRLSDFYFKTKPDYKGRFTVPVLWDLETCTIVNNESSDIIGIMNSA
AFDEFVGEEYRQVRLVPRSLEAQITEFNSWVYDKINNGVYKAGFAECAEVYEREVTSLFQ
YLDKLENLLDKKYTDLEAEYGKNNKDKILDRYFAIGDTLTEADVRLYPTIVRFDVVYHQH
FKCNLATIRDDYSRIHTWLKNIYWRHEAFQRTTDFTHIKLGYTRSQPRVNPIGITPLGPK
PDIRPP
```

\>YMR273C, 3248 bp, CDS: 501-3248 (SEQ ID NO 321)
```
AAATTGGTCTCAATCTGGAATAAGTGCTACTTCGCACTGCTGGTCCTTGGATTAATATCC
CTGAAGGATACCTTACAAACTCTGGTAGGAACTCCTGGTTATAGAATAACCCTTTAGCCT
TTTTTACGTACTTGTATACCGTTTAAAATTTCCTATGTACTATAACCTTTTTTCACTACT
ATTATGGAATTCTATCGAGCGACCGGGCTTTTGTTACGGAAGAGTGAAAAAATCGAGTTT
TGGTGTTTTGGTGAAAGAATTTGGAGGACTATAAAGTACCTATACTTTGTATTACGGACT
CAATAACAAGTCGTTCGTGTCAGTGGTATTGAAGTTGTCAGATCTAAGAGTAGAGAGAAG
GTGGCATCTAATAGGTTTCGACGTTTTTCTTTTTTTAAGGTTTTTATTTGGTCTCCTAGA
ATTTAAGGTCTTAGTTAGTTTTGGTTTGTTTTGTGGGTTACATATTTTCAATTCAAAGGA
GAATTTAGCTGTCTTTTATAATGTCCAATAGAGATAACGAGAGCATGCTGCGTACTACAT
CAAGCGATAAGGCGATCGCTAGTCAAAGGGATAAACGGAAGTCTGAAGTTTTGATTGCTG
CACAGTCCCTTGACAATGAAATCCGCAGCGTAAAAAACCTAAAAGATTGTCGATTGGGT
CAATGGATTTACTTATTGATCCAGAATTAGATATAAAATTCGGTGGGGAATCTAGTGGGA
GACGATCATGGTCTGGCACGACATCCAGTTCTGCGTCAATGCCAAGTGACACAACCACCG
TTAATAACACACGATATAGCGATCCAACTCCGCTAGAGAACTTGCATGGGAGGGTAACT
CAGGGATAGAATCCTCCAATAAGACTAAACAAGGTAACTACTTAGGTATAAAAAAGGTG
TTCACTCTCCATCCAGGAAATTAAATGCTAACGTATTAAAGAAAAACTTATTATGGGTTC
CCGCCAATCAACACCCTAACGTTAAGCCTGATAATTTCCTAGAGCTTGTACAAGATACTT
TACAAAATATACAACTAAGCGACAATGGTGAAGATAATGATGGGAATAGCAATGAAAATA
ACGATATTGAGGATAATGGGGAGGATAAAGAATCACAATCATATGAAAATAAGGAGAACA
ACACTATCAACTTGAACAGGGGGCTGTCAAGGCATGGAAACGCGTCACTAATACGAAGGC
CTTCAACATTGCGGAGGTCATATACAGAGTTTGATGATAACGAAGATGACGATAATAAGG
GAGACAGTGCCTCTGAAACAGTAAATAAAGTCGAAGAAGAATCTCCAAAATAAAAGAGA
GACCAGTGTCGTTAAGAGATATAACTGAAGAACTGACAAAGATCTCAAATAGTGCAGGAC
TAACCGACAATGATGCCATTACATTAGCCAGAACTCTTAGTATGGCTGGTTCATATTCAG
ATAAAAAAGATCAACCACAACCGGAAGGGCATTATGATGAAGGAGATATTGGTTTTTCAA
CTTCACAAGCGAATACTTTGGATGATGGTGAATTTGCCTCCAATATGCCCATCAATAATA
CCATGACATGGCCTGAACGATCGTCACTGAGAAGGAGTAGATTCAACACTTATCGAATCA
GGTCACAAGAGCAAGAAAAGAAGTAGAACAAAGTGTGGATGAAATGAAAAACGACGACG
AAGAACGTCTAAAATTGACCAAGAATACAATAAAGGTCGAAATAGATCCGCACAAATCCC
CTTTTAGACAGCAAGATGAGGATTCTGAGAATATGAGTTCGCCTGGGTCAATTGGTGATT
TTCAAGACATTTATAATCATTACAGACAGTCTAGTGGCGAGTGGGAACAAGAAATGGGAA
TAGAGAAAGAAGCCGAAGAGGTACCCGTCAAGGTTCGAAATGACACAGTAGAACAAGACT
TAGAGTTAAGAGAGGGAACAACAGACATGGTAAAGCCAAGCGCAACGGATGACAACAAAG
AAACGAAGCGACATCGTCGAAGAAACGGATGGACATGGTTGAACAATAAAATGAGCAGAG
AAGACGATAACGAAGAAACCAAGGGGACGATGAAAATGAAGAAAACGTGGATTCACAAA
GAATGGAGCTCGACAATTCCAAAAAACATTATATTTCTCTATTTAATGGCGGTGAGAAGA
CGGAGGTGTCAAATAAGAAGAAATGAACAATTCAAGTACTTCCACCGCCACATCACAGA
CAAGACAGAAAATCGAGAAAACTTTTGCGAACCTATTCAGAAGAAAGCCACACCACAAGC
```

ATGATGCATCATCATCACCCTCGTCGTCACCATCATCGTCACCATCAATACCAAATAACG
ATGCCGTGCACGTTCGCGTGAGGAAAAGCAAAAAGCTTGGTAACAAAAGTGGAAGGGAGC
CGGTTGAACCCATTGTGTTGCGCAATCGCCCTCGTCCTCACCGTCACCATCACAGCCGTC
ATGGTTCCCAAAAAATAAGCGTAAAAACCCTTAAAGATTCTCAGCCGCAGCAGCAGATAC
CATTACAACCACAATTGGAAGGCGCAATAGAGATAGAAAAGAAAGAGGAAAGCGATTCCG
AGAGCTTGCCCCAACTACAGCCGGCCGTTAGTGTAAGTAGTACCAAAAGTAACTCTAGAG
ACAGAGAAGAAGAGGAGGCAAAGAAAAAGAACAAGAAGAGGAGCAATACGACAGAAATTT
CCAACCAACAACACTCCAAACACGTCCAAAAGGAGAATACCGATGAGCAAAAAGCTCAAC
TACAAGCTCCAGCTCAAGAACAAGTCCAAACTTCAGTCCCAGTTCAAGCTTCAGCCCCAG
TCCAAAATTCAGCCCCAGTCCAAACTTCAGCCCCAGTTGAAGCTTCAGCTCAAACTCAGG
CTCCAGCGGCACCACCATTGAAACATACCTCCATATTGCCCCAAGAAAGCTTACATTTG
CAGACGTCAAAAAACCTGACAAACCAAACTCCCCGGTTCAATTCACAGACAGTGCCTTTG
GGTTCCCACTGCCTTTGCTGACAGTGTCTACGGTTATCATGTTCGACCACCGTCTACCAA
TTAACGTCAAAGGGCCATATACCGGCTGAGTCACTTGAAATTGAGCAATTCGAAGAGGG
GACTGCGCGAGCAGGTATTACTAAGTAACTTCATGTATGCTTATCTGAACTTGGTTAATC
ACACTCTGTACATGGAGCAGGTAGCCCACGACAAAGAACAACAACAACAACAACAACAAC
AACCCTGA

>YMR273C, 915 aa (SEQ ID NO 322)
MSNRDNESMLRTTSSDKAIASQRDKRKSEVLIAAQSLDNEIRSVKNLKRLSIGSMDLLID
PELDIKFGGESSGRRSWSGTTSSSASMPSDTTTVNNTRYSDPTPLENLHGRGNSGIESSN
KTKQGNYLGIKKGVHSPSRKLNANVLKKNLLWVPANQHPNVKPDNFLELVQDTLQNIQLS
DNGEDNDGNSNENNDIEDNGEDKESQSYENKENNTINLNRGLSRHGNASLIRRPSTLRRS
YTEFDDNEDDDNKGDSASETVNKVEERISKIKERPVSLRDITEELTKISNSAGLTDNDAI
TLARTLSMAGSYSDKKDQPQPEGHYDEGDIGFSTSQANTLDDGEFASNMPINNTMTWPER
SSLRRSRFNTYRIRSQEQEKEVEQSVDEMKNDDEERLKLTKNTIKVEIDPHKSPFRQQDE
DSENMSSPGSIGDFQDIYNHYRQSSGEWEQEMGIEKEAEEVPVKVRNDTVEQDLELREGT
TDMVKPSATDDNKETKRHRRRNGWTWLNNKMSREDDNEENQGDDENEENVDSQRMELDNS
KKHYISLFNGGEKTEVSNKEEMNNSSTSTATSQTRQKIEKTFANLFRRKPHHKHDASSSP
SSSPSSSPSIPNNDAVHVRVRKSKKLGNKSGREPVEPIVLRNRPRPHRHHHSRHGSQKIS
VKTLKDSQPQQQIPLQPQLEGAIEIEKKEESDSESLPQLQPAVSVSSTKSNSRDREEEEA
KKKNKKRSNTTEISNQQHSKHVQKENTDEQKAQLQAPAQEQVQTSVPVQASAPVQNSAPV
QTSAPVEASAQTQAPAAPPLKHTSILPPRKLTFADVKKPDKPNSPVQFTDSAFGFPLPLL
TVSTVIMFDHRLPINVERAIYRLSHLKLSNSKRGLREQVLLSNFMYAYLNLVNHTLYMEQ
VAHDKEQQQQQQQP

>YNL112W, 3143 bp, exon1: 501-1773, intron1: 1774-2775, exon2: 2776-
3143 (SEQ ID NO 327)
CTTGATGGATTTATGTGACGTTGTAGAATCTAAGTTTACTGAAAAAATCAAGAGCATGTA
GATGTTACGGATCGACTCAAAGACCCTCTGTCACTCTGAAATTTCTAATAATTATGCACA
CCACGCTAGTATAGATACAGCTTGATTTGTGTATCCCGTTTATAGTCGTGCTATTTAAAA
TCTATGTATAATATAACCAGATAAAAATACACCTTCGTACAAGGTGCTAATAATGTTGAG
AATTCGAAATTCCTTTTTAAAGGCGTATTCCGTATTGAATGATTGAAAAATTTATTTCTT
TTTTTATTTCTTTTTTTTTTTTTTTTTTTTTTTTTTTACGCCGATGCTCATCGCAGAAAAT
TTTTCCTTCAGTTTATTTGTCTTATAAAAGACTGTCCTACGCTCAAATAACTTATACTT
TTCTGTATCTCATTCAAATTATTTCTTGTCAACAACCTGTAACAGAATTAAGCACTATT
AAGGCAAATTTAGAGCAAATATGACTTACGGTGGTAGAGATCAGCAATATAACAAGACTA
ACTACAAGTCTAGAGGTGGCGACTTCCGCGGTGGAAGAAACTCTGATAGAAACTCTTACA
ATGACAGACCACAAGGCGGTAACTACCGTGGTGGTTTCGGTGGTCGTTCCAATTACAACC
AACCCCAGGAATTGATCAAACCAAACTGGGATGAAGAATTACCCAAATTGCCAACTTTCG
AAAAGAATTTCTATGTTGAACACGAAAGTGTTCGCGACAGATCGGACAGTGAGATTGCTC
AGTTCAGAAAGGAAAATGAAATGACTATTTCCGGACACGATATTCCAAAGCCAATCACCA
CTTTCGATGAAGCTGGTTTCCCAGACTACGTTTTGAATGAAGTGAAGGCTGAAGGATTTG
ACAAACCAACTGGCATTCAATGTCAGGGTTGGCCAATGGCTTTATCTGGTAGGGACATGG
TTGGTATTGCTGCCACTGGTTCCGGTAAGACTTTGTCTTATTGTTTACCAGGTATTGTTC
ATATCAACGCTCAACCATTATTGGCTCCAGGCGATGGACCAATTGTTTTGGTTTTGGCTC

```
CAACTAGAGAATTGGCTGTTCAAATTCAAACAGAATGTTCCAAGTTTGGTCATAGTTCCA
GAATCAGAAATACCTGTGTCTACGGTGGTGTTCCAAAAAGTCAACAAATCAGAGATTTAT
CTCGTGGCTCTGAAATTGTTATTGCTACTCCAGGTCGACTAATTGATATGCTAGAGATTG
GTAAGACTAATTTGAAGAGAGTCACTTACCTGGTTCTTGATGAAGCTGATAGAATGTTAG
ATATGGGTTTTGAACCTCAAATCAGAAAGATTGTTGATCAAATCAGACCTGATAGACAAA
CCTTGATGTGGTCTGCCACTTGGCCAAAGGAGGTGAAGCAACTAGCCGCTGATTACTTGA
ATGATCCAATTCAAGTTCAAGTTGGTTCTCTAGAACTATCTGCCTCCCATAATATTACTC
AGATCGTCGAAGTTGTTTCTGATTTCGAAAGAGAGATCGTTTGAACAAGTACTTAGAAA
CAGCCTCTCAAGACAACGAATACAAGACATTAATCTTTGCTTCTACGAAAAGAATGTGCG
ATGATATCACCAAGTATCTAAGAGAAGATGGATGGCCCGCCTTGGCTATTCATGGTGACA
AAGACCAAAGAGAACGTGACTGGGTTCTACAAGAGTTTAGAAACGGTAGATCCCCAATTA
TGGTTGCTACTGATGTGGCCGCCAGAGGTATCGGTATGTTAAAATTTTCTCCATTTTTTT
ATTGATTTTATTTTTTTTTGTTACCCCTAACGATATTACAGCTATTTCCTAATGGCTTTT
AATGACATTAATGACTTTATGACAACCATGATAGTACAGAAGAGAGACCTTTTTTCTTTT
TTTTTTTTTTTCTTTTTTTTTTTTTTTCTTTTTTTCTTTTTTTTTTTTTTGAGCCTTT
TCGAATCTAGACTCTATGTGAGTCTATTCTCGATGGGGAGTATCGGAAATTGAATTTTAA
TTCGAATGACTTCTAATGCATCACTACAGAAAACTAATATTGGGAGGATGAGAAAAATTG
ACTTTAATTAGTCGTTTGAGAGACGGGAATTATAAACTCGGAGAAGTGTATTTGTGTT
CATGATTTGCACTTCATGTCAAAAGAAATTTCGCTTTTTGACATCGGCGCAAATAAACAA
GGAATTGGCTTTTCAGCTTATTTCTAGAACGCATACATACGCTTCGTTGATCGTTGTTTT
TTTCAATGCTTGGCATTTGTACAAGGGTAGATTGTTTTATTGGAAAAATAATAGTATATT
CTACTTTGAAATGCCGTCATCCTTCTTGACTATTGTTATTCTCATTTTGTGTAGTTTATG
CATTTTGTAGTTATATTGAGATACTGTTGCATCCCAAGTTCGAATTATTAAGAAGTGCTG
ATAAAAATGGAAAATAACAAAATAAAAGGATTTCAACCATATTCAGAAATCATTTACTTT
GTTTTCCTTTTTTTAAGTGCTAGCTTTCATTCAGTTTGAATAAGGATTCTGGAGTATTGA
TGATTAAATATTTCGAATTCTTTAATAAAAATATAATTTCTGATAATCTTCAAGCCAGGG
GGAAATTTGAGACAATGTTGGGAGTCCAAACATGAATTTGTGGGGGGCATGAAAATAAAG
TTCATATACAGAATAACGAACCAAATTACTAACAGTATGCTTTGTAAACGTTTGTTTACT
TCTTTATTTTTTCAGATGTCAAAGGTATCAATTACGTTATCAACTACGATATGCCAGGTA
ACATTGAAGATTATGTTCACAGAATCGGTAGAACTGGTAGAGCAGGTGCTACTGGTACTG
CTATATCTTTCTTCACCGAACAAAACAAAGGTTTAGGTGCTAAATTAATCTCTATCATGA
GAGAAGCTAATCAAAATATTCCTCCCGAATTATTGAAATACGACAGGAGATCTTATGGTG
GCGGTCACCCAAGATACGGTGGTGGTCGTGGTGGTCGTGGTGGCTATGGCCGTAGAGGTG
GTTACGGTGGTGGCCGTGGTGGTTACGGCGGTAACAGGCAGAGAGATGGTGGCTGGGGTA
ACAGAGGTCGTTCAAACTATTGA
```

>YNL112W, 546 aa (SEQ ID NO 328)
MTYGGRDQQYNKTNYKSRGGDFRGGRNSDRNSYNDRPQGGNYRGGFGGRSNYNQPQELIK
PNWDEELPKLPTFEKNFYVEHESVRDRSDSEIAQFRKENEMTISGHDIPKPITTFDEAGF
PDYVLNEVKAEGFDKPTGIQCQGWPMALSGRDMVGIAATGSGKTLSYCLPGIVHINAQPL
LAPGDGPIVLVLAPTRELAVQIQTECSKFGHSSRIRNTCVYGGVPKSQQIRDLSRGSEIV
IATPGRLIDMLEIGKTNLKRVTYLVLDEADRMLDMGFEPQIRKIVDQIRPDRQTLMWSAT
WPKEVKQLAADYLNDPIQVQVGSLELSASHNITQIVEVVSDFEKRDRLNKYLETASQDNE
YKTLIFASTKRMCDDITKYLREDGWPALAIHGDKDQRERDWVLQEFRNGRSPIMVATDVA
ARGIDVKGINYVINYDMPGNIEDYVHRIGRTGRAGATGTAISFFTEQNKGLGAKLISIMR
EANQNIPPELLKYDRRSYGGHPRYGGGRGGRGGYGRRGGYGGGRGGYGGNRQRDGGWGN
RGRSNY

>YNL131W, 959 bp, CDS: 501-959 (SEQ ID NO 329)
```
CAAAAGAGCTAATCAACTCCTTGAACTTAGATAAATACGCCATAAATGATAACAGTGAG
GAATGGGCTGAATCTCAAAAATCTTTAGAAATAGCTGCCAAGGCCAAAGGCGTCGTCAGT
TTAAAAACTGGTAAAAGAGAACGACTGAAAAGGCTGAAGATATCTATAGACAAGAGATG
AAAGCTATGAAAAAACCAAGAAAGTCTAAAAAGGCTGCAAATTAAGCGTTCTACTCTTTG
TCAAACCCTTTTATAGCTAAACGTTTACTTAATTTGTACAATAATATAGAATAGAAACAT
AGTTGATGTTTGAACCTTTACATATTCCTTTCAATCGTGTCGAGCGATATAAGTATTACG
ATTATGCCGGCGAAAACTGAACCCGTTTTAGACAATTTCAATCAACATACTCCACTCCGT
```

```
AGTGAGTAACTTTTGGAGTAATACGAAGTAACCAAAGAGGTCAAAACGGAACTATATACC
CCAAAATAAGCATCATTCAAATGGTCGAATTAACTGAAATTAAAGACGATGTCGTTCAAT
TAGACGAACCACAATTTTCCAGAAATCAGGCCATCGTGGAAGAAAAGGCTTCTGCAACAA
ACAACGACGTTGTCGATGATGAAGATGACTCTGATAGTGATTTTGAAGATGAATTTGATG
AAAATGAAACATTGTTGGACAGAATCGTTGCTTTAAAAGACATTGTCCCCCCAGGTAAGA
GACAAACAATTTCTAATTTTTTTGGTTTTACTAGCTCTTTTGTGAGAAATGCTTTCACAA
AATCCGGAAACCTTGCTTGGACTTTGACCACCACTGCTTTGTTACTCGGTGTGCCACTAT
CCTTATCTATACTTGCCGAACAACAGCTAATCGAAATGGAAAAGACATTTGATTTACAAA
GTGATGCTAATAACATATTGGCCCAAGGTGAAAAAGATGCTGCAGCAACAGCCAATTAA
```

>YNL131W, 152 aa (SEQ ID NO 330)
MVELTEIKDDVVQLDEPQFSRNQAIVEEKASATNNDVVDDEDDSDSDFEDEFDENETLLD
RIVALKDIVPPGKRQTISNFFGFTSSFVRNAFTKSGNLAWTLTTTALLLGVPLSLSILAE
QQLIEMEKTFDLQSDANNILAQGEKDAAATAN

>YNL143C, 893 bp, CDS: 501-893 (SEQ ID NO 333)
```
GAAAATACACACGGCGGAAGCCATCATCGAGGCCCAAAGCAAGGATAAAGCATGCTTTTT
CCTGGATAAACCAGAATATAATAAACCGATACCTGGGACCATAATCCACACACCTGCTGA
AGCCACACCGATCCATCCCATGTTGGCCAAGTCAAATTGTGTATTCAAATCTGTTGTCAA
CGAGTTACCACCCGTTCCTTCGCCTGTAGGCGTACCTGTAAAATTGTAAGACATTGTTGA
TATTGTATTGTAATATATTAAGTATGATATATTACAAAACTAAACTTCTTTCAAAGCTCT
GTGCAGACTTATTATTTAAGAAGGATATTTAATTTGAAAGGACGTGAAAGCACGAATGAT
TACTACCCACTGATGTTTGGTTAGCACATGTGTAACTACTGCTTATATATGGTGCAGAAA
AGTGGCTCGGAATGAACACCTCTTGTACTGAATACTTCATTGATAAGGCACAGGGTCTTC
ACGCCGCTTAGTATTCGTCGATGCGTGAGCAATTGAAGCTTTTTACGAGGGAAATAGTCG
ATTTTACATTTCTTATCTTATCTGGCTTTGACTATTACCAGACACTCTTGATAAGCAGTA
ACAGCAGTAAGAAGAGACCGAAGGATTCTTCTTTGTTATCGGAAAAAAAAAAAAAAAAA
AAAAAAAAAAAAAGATGTCTTATCTTATCTTTCTTATCTTAAAGACCTACCATTTGTTC
CTTTTCTATTTTGGCAGCCCGGGTATTCGCAAAGGGAAAAAAACCCAAGACAGCATTCCT
TGTTCATTATGACTATTACAAAGCCAGGAATGATTTCGATGGCCGACATGAATTACGTCG
TTTCCAAGAACAGAAGCTTAAACCGTCCTGCTGAGCGGGGCGGTAATCGGTGA
```

>YNL143C, 130 aa (SEQ ID NO 334)
MREQLKLFTREIVDFTFLILSGFDYYQTLLISSNSSKKRPKDSSLLSEKKKKKKKKKDV
LSYLSYLKDLPFVPFLFWQPGYSQREKNPRQHSLFIMTITKPGMISMADMNYVVSKNRSL
NRPAERGGNR

>YNL179C, 938 bp, CDS: 501-938 (SEQ ID NO 335)
```
ACAGCGGTTAATTTCAAATACCCTAATCGGAGGTCTTATCTTATTTTCAAGGGCAAGGC
TCTCCACATCGGTAAGTGATGACCAGATAATGGAAAGTAGCAGAATTTTATTTATGTGCC
ATACAAGCCCGGAGAAACAGAGTAGCTAAAAAATTAAGGTGTGCAAAAGTGGTTTTGTTC
CCCGACGCCCGGGCCTTTCTCTCCCTGAATCTTTTCGTTCCGGCCCCCCTCTCAATA
CCAGATCTGCATCTATACTAAAGCTGCAGTGAGAGTAAACCGGAAAATTATCCTGCGTGT
TTGCTTCGGTCTTAGCTTTTACTTGGGTATGCGAGAACCTCTAAGAGCTTAGACCGGTCT
TCCTCCCTAAAAAGAAAATTATAAAAGGTTATTATCTGGACTAAAGCAAAAAAAAACAA
CGTTTCGGCGTCCGCTCAAAATTTTCATTACGCTTCTTGGTCAAATCAGTTACGTAACGG
GTTATGACGAATACGATGAGATGAGTAATTGCAGAAGGCTCCTATGCAGACAGCTAAGCA
GTGCTTACTTGAATTACCTTCCCTTTTATTTCTTGATATATCGTCCTTTTCTCTCTATC
TTAGTTCTTGCGAGTACTGGCAATCATGTTTCTCCTTTTTTTTTCTTTTTTTTTATTTT
TTTTTTTTTTTTACTTTTCAGTTTCTCGTAGCTTTTCCTATTTTGCTATTTAAAGTAA
GTTTAAATAGTACCCTCACTAAACACGTACGGCCGATCCACCAACGAACAAAAGCACGAT
CCTTGACCCATCATTGTATTCCAAAGCGTTGGAACATTCACTTTTTTTTTTCCGGTCTAT
TGCACAAGACAATATCCAGAATATTCAGTTGGATAGGAAATACAAGACAGGTGGCACCCA
CAAAGCACACGCCGAAATATTTATTAAATACAATATAG
```

>YNL179C, 145 aa (SEQ ID NO 336)
MSNCRRLLCRQLSSAYLNYLPFYFLIYRPFSLYLSSCEYWQSCFSFFFLFFLFFFFFFTF
QFLVAFPILLFKVSLNSTLTKHVRPIHQRTKARSLTHHCIPKRWNIHFFFSGLLHKTISR
IFSWIGNTRQVAPTKHTPKYLLNTI

>YOL150C, 812 bp, CDS: 501-812 (SEQ ID NO 349)
TTCCCATTTCCACTGCTATTCCTGTTGCTATTGTCAGAACCATTGTTTACTTGAATGTTA
TTACTACCATTTTGTGAATCAAAAATATCTACTTCTTGTGGGGAGACGGGTAGAAGATTT
GTATTTTGCGAGACGTCTCTCAAATATATGGCCAAAACACCTTGATATTCTAGTTTATTC
CATTCGTCCTTCTTGAAGTCCCATTTATACAGTGACGCATGTGGTGTGTGAAAAAGTAGT
TGCTTTATTTTTGGATCGTATCTCCCAATAACGTTGAAATTCAAAGCTTTTCTATAGAAT
TCTAACTGTGTGGCAGAGTTTTCTGCTGCAGTTGCTGCTCCGGTCATTGTGCACAGCTTT
TCTTGTGATGTGTTGCAAAGATAAATGCTTATCTGAACGTTTCTCTATTGTTTTTTCGTC
AATTTTCTTTTCTTTCTTGCTTCGCGTTTTCGACATATTAAGCTGTATATAGAAGAGAAA
AATGCGCAGAGATGTACTAGATGATAAAAAATAATTGTAATAACGTTAATATATATAAAT
ATTATCTATTTTCATTTAAAGTTTATATTCTGCCCTCAAATTTTAAAATTTGGGAGGCAG
TGTCGTCAATGGTCTCTTTCAAGTTCCTGAACTTGAAACCTAACAATTTCTTACTCTTTT
TATTATCAAGAGTAGCACCAAGGGTGTTATGGGTAGCACCAGAACCTGGTTTCCCCACTG
GAATATTGCCTTTTAGAACAGGGAAGTCTTCGTTAAGGATATCGAGAACATCCTGCATAG
TAAATCTGGCCTCCGATACGATTAGTCTTTGA

>YOL150C, 103 aa (SEQ ID NO 350)
MIKNNCNNVNIYKYYLFSFKVYILPSNFKIWEAVSSMVSFKFLNLKPNNFLLFLLSRVAP
RVLWVAPEPGFPTGILPFRTGKSSLRISRTSCIVNLASDTISL

>YOL151W, 1529 bp, CDS: 501-1529 (SEQ ID NO 351)
GCGTGAACTATGTCATATTTGCGATTTTAGGTACAATAAATATTATCATTATTATATTAT
GTTTGCATGTAGGTTCTACAAATACATTGTTGTACGCTATAGTTTCCTTTCAAAACTAGA
AAGAATTCGTAACAAAATAATCTCCAATATTTTATAGCACCTTATTAATATCAATGCTGC
AATACCTTCTCATTTCAACAATTGGCCCTCACCTCTTTTGTACAAAAAACGTCGCCATTG
ATAAAATAAGTAAGAAGCATATAATTGGAATGTCCATTACGTAAAAGAAAAAAAATCATG
TGTACATATTACGTAATAGAATACGGAATTTTCTCGCGGAAGTAGATCTTCCGTGGAAAA
AAAGGAAAAAGTCCGATCAATATTGAAAAAGGGATCCTTAGTTTCCCAACTATATAAGGA
GGAAAAGTCTATCTCTGTAGCGTTGATATAACGTGTACGATTTTCAAACAAACAGATAGC
AGTATCACACGCCCGTAAATATGTCAGTTTTCGTTTCAGGTGCTAACGGGTTCATTGCCC
AACACATTGTCGATCTCCTGTTGAAGGAAGACTATAAGGTCATCGGTTCTGCCAGAAGTC
AAGAAAAGGCCGAGAATTTAACGGAGGCCTTTGGTAACAACCCAAAATTCTCCATGGAAG
TTGTCCCAGACATATCTAAGCTGGACGCATTTGACCATGTTTTCCAAAAGCACGGCAAGG
ATATCAAGATAGTTCTACATACGGCCTCTCCATTCTGCTTTGATATCACTGACAGTGAAC
GCGATTTATTAATTCCTGCTGTGAACGGTGTTAAGGGAATTCTCCACTCAATTAAAAAAT
ACGCCGCTGATTCTGTAGAACGTGTAGTTCTACCTCTTCTTATGCAGCTGTGTTCGATA
TGGCAAAAGAAAACGATAAGTCTTTAACATTTAACGAAGAATCCTGGAACCCAGCTACCT
GGGAGAGTTGCCAAAGTGACCCAGTTAACGCCTACTGTGGTTCTAAGAAGTTTGCTGAAA
AAGCAGCTTGGGAATTTCTAGAGGAGAATAGAGACTCTGTAAAATTCGAATTAACTGCCG
TTAACCCAGTTTACGTTTTTGGTCCGCAAATGTTTGACAAAGATGTGAAAAAACACTTGA
ACACATCTTGCGAACTCGTCAACAGCTTGATGCATTTATCACCAGAGGACAAGATACCGG
AACTATTTGGTGGATACATTGATGTTCGTGATGTTGCAAAGGCTCATTTAGTTGCCTTCC
AAAAGAGGGAAACAATTGGTCAAAGACTAATCGTATCGGAGGCCAGATTTACTATGCAGG
ATGTTCTCGATATCCTTAACGAAGACTTCCCTGTTCTAAAAGGCAATATTCCAGTGGGGA
AACCAGGTTCTGGTGCTACCCATAACACCCTTGGTGCTACTCTTGATAATAAAAAGAGTA
AGAAATTGTTAGGTTTCAAGTTCAGGAACTTGAAAGAGACCATTGACGACACTGCCTCCC
AAATTTTAAAATTTGAGGGCAGAATATAA

>YOL151W, 342 aa (SEQ ID NO 352)
MSVFVSGANGFIAQHIVDLLLKEDYKVIGSARSQEKAENLTEAFGNNPKFSMEVVPDISK
LDAFDHVFQKHGKDIKIVLHTASPFCFDITDSERDLLIPAVNGVKGILHSIKKYAADSVE

RVVLTSSYAAVFDMAKENDKSLTFNEESWNPATWESCQSDPVNAYCGSKKFAEKAAWEFL
EENRDSVKFELTAVNPVYVFGPQMFDKDVKKHLNTSCELVNSLMHLSPEDKIPELFGGYI
DVRDVAKAHLVAFQKRETIGQRLIVSEARFTMQDVLDILNEDFPVLKGNIPVGKPGSGAT
HNTLGATLDNKKSKKLLGFKFRNLKETIDDTASQILKFEGRI

>YOR131C, 1157 bp, CDS: 501-1157 (SEQ ID NO 359)
TCCTGAACGGAAGCTGCAGTTTGCTCAGTACCTACACGCTCCTCTGACATAGAAGATGAT
CCATCTGTGGTTGTTGCAGCAGGTTCAGAATCTTCCTCCTGGGGCTCAGCAAATGGATTG
TTATCCAGATCATCATATGGATCATAAGGTACAGCCGAAGTCATTGTTCAGAGGATAGAT
GGATTGACTAAGGGTACAGTACGGCAAAAAAAAATTAGATCAGCTTTTCAAAACAAACTA
TTTTGGCGTTTACCAAAACCAAAACAGTATATTCAACTAGTTCAATCACTCTTGAAAACG
TCCCCTTTCTACAAAATTAGGCTTTGAACGCGTGCTATGGAAAAAAGTGTAAAGAAAACG
AAAAAACCAGAAAAGTCATATATATCTTATAACGAAATATCAGGGTGTTCGACTCAATCG
CCAGGTGCCGCTAACACAATCATTAGGATAGTCGGGCAATATATACGGTTCAATAGTCAC
TGAAAGTGTATCACAGAATAATGACAAAGCTACAAGGACTACAGGGATTAAAACACATCA
AAGCGGTTGTATTTGATATGGATGGCACATTATGCCTACCCCAGCCTTGGATGTTTCCAG
CAATGAGAAACGCCATAGGATTGGAGGACAAATCGATTGATATCCTTCATTTCATTGATA
CATTGCCCACAGAAAAAGAAAAAAAAGAAGCGCATGATAGAATAGAATTAGTTGAGGCAA
AAGCCATGAAGGAGATGCAACCGCAGCCTGGTCTGGTTGACATAATGAGGTATTTGACGA
AAAATGGTATTAGCAAGAACATATGTACTAGAAATGTCGGAGCCCCGGTAGAGACTTTTG
TTAAAAGATTTATTCCATCCGAGCTTTCGAGGTTTGACTATATTGTGACAAGGGAGTTTA
GGCCTACAAAACCGCAACCAGACCCATTATTACACATCGCCTCGAAGCTAAATATAAGGC
CCTTGGAAATGATCATGGTAGGAGATTCATTTGACGACATGAAATCCGGTAGATCTGCTG
GATGTTTCACGGTATTACTCAAGAATCATGTGAATGGACATTTACTGCTCGAACATAAAG
AACTAGTAGACGTTTCAGTAGAGGATCTTTCCGAAATAATTGAATTGATTCAAAATATGA
ATAAAGAAAGTTTCTAA

>YOR131C, 218 aa (SEQ ID NO 360)
MTKLQGLQGLKHIKAVVFDMDGTLCLPQPWMFPAMRNAIGLEDKSIDILHFIDTLPTEKE
KKEAHDRIELVEAKAMKEMQPQPGLVDIMRYLTKNGISKNICTRNVGAPVETFVKRFIPS
ELSRFDYIVTREFRPTKPQPDPLLHIASKLNIRPLEMIMVGDSFDDMKSGRSAGCFTVLL
KNHVNGHLLLEHKELVDVSVEDLSEIIELIQNMNKESF

>YOR286W, 950 bp, CDS: 501-950 (SEQ ID NO 367)
CATCTGAGTACTCGATTGTTCATATTCCTGCTTCCATCAATGTGCCATATAGATCGCACC
CTGACGCATTTGCCTTAGATCCTTTAGAATTTGAGAAACAGATTGGCATCCCAAAACCTG
ACAGTGCCAAGGAGCTAATATTTTATTGTGCTTCTGGCAAACGCGGGGGAGAAGCTCAAA
AAGTCGCCTCCTCACATGGATATTCAAACACCTCACTATATCCTGGCTCTATGAATGATT
GGGTTTCTCATGGGGGTGATAAACTTGACTTATAGCCTTGTATACTCTAGGTATGTACCC
TGTGTATTTTCGTAAGCTAGTAACGTATTATGCCATTTATGTCACACCGTTCATAATATT
TGCCTATTGCATTGGCTGTGATAGCGGCGGCGCAAAGAAATTAGGAAGTATAAAAAAAAA
AATACAAAACTTAATCTGAATGGAATAAGATAGCGATAACTCTCAACAAATGGAAGCGAG
ACAGAAGAAAAGACCAACGATGTTCAAGCATAGTACAGGTATTCTCTCGAGGACAGTTT
CTGCAAGATCGCCTACATTGGTCCTGAGAACATTTACAACGAAGGCTCCAAAGATCTATA
CTTTTGACCAGGTCAGGAACCTAGTCGAACACCCCAATGATAAAAAACTATTGGTAGATG
TAAGGGAACCCAAGGAAGTAAAGGATTACAAGATGCCAACTACAATAAATATTCCGGTGA
ATAGTGCCCCTGGCGCTCTTGGATTGCCCGAAAAGGAGTTTCACAAAGTTTTCCAATTTG
CTAAACCACCTCACGATAAAGAATTGATTTTTCTTTGTGCGAAAGGAGTAAGAGCCAAAA
CTGCCGAAGAGTTGGCTCGATCTTATGGGTACGAAAACACTGGTATCTATCCTGGTTCTA
TTACTGAGTGGTTAGCTAAAGGTGGTGCTGACGTTAAGCCCAAAAAATAA

>YOR286W, 149 aa (SEQ ID NO 368)
MFKHSTGILSRTVSARSPTLVLRTFTTKAPKIYTFDQVRNLVEHPNDKKLLVDVREPKEV
KDYKMPTTINIPVNSAPGALGLPEKEFHKVFQFAKPPHDKELIFLCAKGVRAKTAEELAR
SYGYENTGIYPGSITEWLAKGGADVKPKK

>YOR382W, 962 bp, CDS: 501-962 (SEQ ID NO 375)
AGTAAGCTCCTACAGTGAAATATCTGGGTGCTACTGACGCCAAGCCCTACAGCGATCGGA
ATGCGGGAACGGAAGTTAACGGGGCTTCCAGAACGGCGGAAGCGAATTGAACGAGGACGG
CAAACAAAAACACCCAAAATTTCATTACTTAGAATGACCCTCAAGAGCAGGGTGCAATTT
ATCAAGCGATCATTGAACTAACTAAGTTCATATCCTGTATAGGATTTAAAACAATGCACC
CTAAGTTCAAATGCACCCCCCTCGCCCCGCAGCGGACCCTTGAACAGAGAACTGTTTCG
AGGTTCACCCAATTGGATCACTTGTATAATTTGTAATCGAGTTCGGATAAGATGTATACG
AATCTAACTGGGTGCAGTATAATTAGCATTTTATATTACCTAGCAATATATGTATAAAAC
AGGAATGTGTGCGTGCTTCAGGCAGAATTTTACGGTCCTTGTAAAAAGTCTATCATAAA
GCCATCACAAAACAATAATAATGAAATTCTCAACTATTTTCGGAGCTACTACAGTTATGA
CTGCCGTCTCGGCAGCAGCTGTGTCGAGTGTAATGACCACTAAGACTATTACTGCTACTA
ACGGTAATAACGTTTACACTAAGGTCGTTACCGACACCGCTGACCCTATCATTAGTTACA
GTACCACTAGAACTGTCGTTGTCAGTAATAGTGATGCTACTTACACAAAGGTTGTCACCG
AAGGACCAGATACCACCTCTGAAAAGAGTACAACAAAGACACTTACTTTGACAAACGGTT
CAGGTTCATCAACCAACCTTTACACCAAGACCGTCACTCAAGCCGTCGAATCATCTACAT
CCTCCTCATCCTCCTCATCCTCCTCCTCCTCTTCTGCCTCTTCTTCTGGTGCTGCTCCTG
CTGCATTCCAAGGAGCAAGTGTCGGTGCATTGGCCCTTGGTTTGATTTCTTACCTATTAT
AA

>YOR382W, 153 aa (SEQ ID NO 376)
MKFSTIFGATTVMTAVSAAAVSSVMTTKTITATNGNNVYTKVVTDTADPIISYSTTRTVV
VSNSDATYTKVVTEGPDTTSEKSTTKTLTLTNGSGSSTNLYTKTVTQAVESSTSSSSSSS
SSSSSASSSGAAPAAFQGASVGALALGLISYLL

>YPL078C, 1235 bp, CDS: 501-1235 (SEQ ID NO 379)
TAAACTGTGTTGTGACGCAACTGCAACTCCCAGATGAAATACGGTCCGGTAAAGATAGGA
ATATTCTACTCTACAAGCATGAATATTTTTAACGCGGCGCAGTACTATACAGCATAACA
GGTCTTCCACGCATGAGAAACTGTCCATGGCTAAATTAGTTCCTCACACAGAATTAGAAA
TGTGCTGTGACAATGGCACATACGTAGATAAAAGATAAATATAATTCAGAATGGCTGTGG
CGACAACTATTATCATAGAGGTGTCCCATCGAGCGAGCCTCATTGGCCGGGTAATCGACA
TCAATATTGAACCAATCACGACGCTTTTTCTCTTCACCGCTCATTCGGACCTTCACCACA
GGTTTGGGTAATTAAAATAGCAAGGGATTATAATTGCAGTTAGCAGTTTATGTTGACAAG
TTTATACTGTGCTAGGAAGGGTTATATTTATTAAAAGACTGACGAGAATTCAGTACCTC
CTAAGTGCGCAAGAGATAAAATGAGCATGAGTATGGGTGTCCGTGGCCTAGCGTTAAGGT
CCGTTTCTAAAACATTATTTAGCCAAGGTGTTCGTTGTCCTTCGATGGTGATTGGAGCCC
GTTATATGTCTTCCACTCCAGAAAACAGACAGATCCAAAAGCAAAGGCTAACTCTATCA
TCAATGCCATTCCAGGTAATAATATTTTGACAAAGACGGGGGTTTTGGGGACTTCTGCTG
CCGCTGTCATTTATGCCATTTCCAATGAATTGTACGTTATCAACGATGAAAGTATTTTAT
TGCTGACTTTTTTGGGTTTCACTGGTTTAGTGGCAAAGTATTTGGCGCCAGCATATAAAG
ATTTTGCCGATGCAAGAATGAAGAAAGTCTCCGACGTTTTAAATGCCTCGAGAAACAAGC
ATGTCGAAGCTGTTAAAGATAGAATCGACTCTGTCTCTCAACTACAAAATGTTGCTGAAA
CTACAAAGGTTTTGTTTGATGTTTCCAAGGAAACTGTTGAACTTGAAAGCGAAGCCTTTG
AATTGAAACAAAAGGTAGAATTAGCTCACGAAGCAAAGGCAGTCTTAGATTCGTGGGTTA
GATATGAAGCTTCCTTGCGTCAATTGGAACAAAGGCAACTAGCAAAATCTGTCATCTCCA
GAGTTCAGTCAGAATTGGGTAATCCAAAATTCCAAGAGAAAGTTTTGCAACAGTCTATAT
CTGAAATTGAACAATTGCTTTCTAAATTGAAGTAA

>YPL078C, 244 aa (SEQ ID NO 380)
MSMSMGVRGLALRSVSKTLFSQGVRCPSMVIGARYMSSTPEKQTDPKAKANSIINAIPGN
NILTKTGVLGTSAAAVIYAISNELYVINDESILLLTFLGFTGLVAKYLAPAYKDFADARM
KKVSDVLNASRNKHVEAVKDRIDSVSQLQNVAETTKVLFDVSKETVELESEAFELKQKVE
LAHEAKAVLDSWVRYEASLRQLEQRQLAKSVISRVQSELGNPKFQEKVLQQSISEIEQLL
SKLK

>YPL085W, 7088 bp, CDS: 501-7088 (SEQ ID NO 383)
TTTTTCATGAGGAAGAGCCAGTGACAGTAAATAATAAAAGGTGAAATGATTAAACAATGA

```
AAGCGGCAGAAAAATAAAATCAAACAGTGGCAGTATTGACTTTTGAAAATCAGAAGTTCA
TCCTAAGTTAAGACTTTCTTCTTTTAAGTGCTTTCTCCTTCTCTCACTGTCTTATCGCTG
TATATCTCATTGTTGAATAATATAACACAACGTTATAAGTGATCATCACTTTCTGATCCA
TAATTTCAAACCTCAAGCGACCGTACATGTGGCATTTTCCACTATAAACTTACGAGCAAG
AGAAAGATATACGGAAAAGGTTAATTGGCAGGTTACACAAGATTTTGGTCATTGAATATT
TGCAGCCCTCCTGCTTGAGAAACTGGACAACAACTGTTATCAATATTCCCTTTTCAAAAT
AGTGGTATTTAACTGGCCATAACCAAGGAAACCGTTGTACCTATTATTTTGTATAGTCTT
CATTTAATAACGTGTTAAGAATGACACCTGAAGCCAAGAAAAGGAAAAACCAAAAGAAGA
AGTTGAAGCAAAAGCAAAAAAAGCTGCTGAGAAAGCTGCTAGCCACAGTGAAGAACCAC
TTGAATTACCAGAAAGTACGATTAACAGCAGCTTCAACGACGACTCGGTGAACCGTACAG
AATCTGACATAGCTTCAAAATCTGATGTTCCTCCGGTCTCATCATCTACCAATATCTCTC
CGGCTAATGAAACACAACTAGAAATACCTGATACTCAAGAATTGCATCATAAACTGCTCA
ACGACTCTGATCAACATGATATTACCGCGGACTCAAATGATTTGCCAGACAACTCAATCG
TTGAACATGACTCTGTTATTACCCAAACAAAACCAGCCATGTCTCAAGAATACGAAGAGA
CTGCCGCTCACTTATCTTCGAGAAATCCATCGCTCGATGTAGTCGCGGGAGAACTTCACA
ATAATAATGAACATACCCAGAAAATTGCCGTATCCGCTGTGGAAGAGGATTCTTTCAATG
AAGAAGAGGGTGAAAATCACGACAGCATAATAATTTCATCATTAAACGATGCTACCCCTT
CTCAATATAATCATTTTCTCCCATCCGATGGCAATCTTCTTTCTCCAGAATTATCTTCTG
GTGATACGCCAACTCACAATGTTCCTCTAGGCACAAAAGACAATGAAATAAATGACGATG
AGTATTGTAATGATAAGGAAATTAGTTTGAACGCAAATAATGTGCTTCCTGATGAACTTT
CAAAGGAAGAAGATGAAAGATTAAAACTAGAAACGCATGTATCAACCGAAGAAAAGAAAC
AGGATATCGCTGATCAGGAAACTGCAGAAACTTATTTACGTCTAGTACAGAACCATCTG
AGAATAAAATAAGAAATTCTGGTGATGATACCTCCATGTTGTTTCAAGATGACGAAAGTG
ATCAGAAGGTTCCATGGGAGGAAGATGTGAAGAAAGATTTTCATAATGAGAACACAAATA
ATACTCAAGAATCGGCACCGAACACAGATGATCGTGATAAGGGTTATGAAGGAAACGAAG
CTTTGAAAAGTCCGAAAGTTGTACAGCCGCGGACGAGAGGTCGTACTCTGAAGAAACTT
CAGAAGATATCTTTCACGGACACGACAAACAGGTAGTTGAAGGCCAAAATGATTTCACTG
GGAAAAATATTGAGAATGAAAGCCAGAAATTAATGGGGGAAGGGAATCATAAGTTACCGT
TGTCTGCCGAAGCTGACATTATAGAACCTGGTAAGGATATTCAAGATCAAGCCGAGGATT
TGTTTACGCAGAGCAGCGGAGACTTGGGAGAAGTTTTGCCATGGGAATCTACTGATAAAA
ACGCTGATGTAACGAGCAAATCCCAAGAGAAACATGAAGATTTATTTGCTGCTTCTGGAA
ACGATGAGAAACTTCCTTGGGAAGTTTCTGACGGTGAAGTATCATCGGGAAAGACGGAAA
ACAGCATGCAGACTAGTACTGAGAAAATAGCTGAGCAAAAGTTTTCGTTTTTGGAAAACG
ACGACGACCTTTTGGACGACGACGACAGCTTTTTGGCTTCTTCTGAGGAAGAAGACACAG
TACCTAATACCGATAATACAACGAATTTAACCTCAAAACCAGTTGAAGAAAAAAAGGCTT
CAAGATATAAACCTATTATCGAGGAGGAAGCAGGAATGCGTCAAGAGCAAGTTCATTTTA
CCAATACTACTGGCATTGTAACACCGCAGCAGTTCCACGGTTTGACTAAAACTGGACTAG
GCACCCCCAACCAACAAGTCAGTGTACCAAATATAGTTAGTCCTAAGCCTCCTGTGGTAA
AAGACAATCGTTCAAATTTTAAGATAAATGAGGAGAAAAAGAAGTCTGATGCTTACGATT
TTCCACTGGAAATTATTTCAGAAAGTTCCAAGAAGGGTCACGCAAAGCCGGTTGCCGTTC
CTACTCAAAGGTTTGGCTCAGGGAATTCTTTTAGTTCTTTGGACAAACCAATTCCACAGA
GCAGGAAAGGCTCTAATAACTCAAATAGGCCACCCGTGATCCCATTGGGGACGCAGGAGC
CTCGATCTTCGAGAACTAACTCAGCGATCTCGCAATCTCCCGTTAATTATGCTTTCCCTA
ACCCATACAAAATTCAACAACTACAACAGGCTCCTATCCAATCAGGTATGCCTTTACCAA
ATACCAACATACCTCCCCCAGCATTAAAAGTGGAAACCACCGTTTCTGCTCCTCCAATTC
GGGCAAGAGGGTCAGCAATGCCTCCGTGGGAAGTTCAGCGTCTTTTGGTGCTAGACATG
CAACACAGTACGGCCTCAATAACGGGGTACCTCCGGTTTCGCCATATGGTCAAGCTACCA
TAAATTTGCCAACTGCGAATAAGTATGCCCCCGTCTCTCCTACAGTTCAGCAGAAGCAAT
ATCCATCAGTTGTGCAAAACCTTGGCGCTTCGGCCGTAAATACCCCCAATTTTGTAAAGA
CCCATAGAGGCCATACAAGCTCTATTAGTTCGTATACACCAAACCAGAATGAACACGCCT
CTAGATACGCACCCAACTATCAACAATCTTATCAGGTGCCATATACCTCACAACCTGTTG
GTCCTGTAGCTGGGAATTCAAGCTATCAAAGCCAAACCCGAAGTTCTTATGCAGTTCCTA
TGATGCCCCAGGCTCAAACTTCAGCAAGTATTCAGCCTCACGCGAACATTCAACCGCCTA
CTGGCATTTTACCTTTAGCCCCCTTACGACCTCTAGACCCCTTACAAGCCGCTACGAACT
TGCAACCCCGTGCAAGCAACATAACGGCTGCAAATTCACTACCTCTTGCAAATTTGCCAC
TTGCTGAAAACATACTGCCAGAAATTATCACGCATCGAGCTACAAGTAGTGTTGCACCAC
```

```
CACGACAGGAAAATAATCCAATTAAAATAGACAACGAGGCTTTATTACGCCGTCAATTTC
CGATTTTTCATTGGAGTGCTGCAAACAAGGTCGTGTACGCAGTCCCCCTATCCCTGACC
AATCGCAGTACATGATTTCATCAAGCATTGTACAGGAAATAAAAGTGACACCAATTGACC
AGATAATTAAACCGAACGATATGCTCAAAAGCTTCCCAGGTCCTTTGGGTAGTGCCAAAT
TAAAAAAAAAGGATTTAACCAAATGGATGGAAACCACTATTAAATCCATATCTGAAAATG
AATCATCCACTGATATGACTATATGGCAACTATTGGAAATGAAACTAAACGATAAAGTTA
ACTGGAAAAATATTTCAAAACTACTATACAATTCTGACGAACTTTTAATGTACCTATCTC
AGCCCTTTCCAAACGGTGACATGATTCCAAATGCATATAGACTGGATATAAATTGTCAGA
TGAGAGTCCTGGCGTTCTTACAAACGGGAAATCACGATGAGGCACTTCGCTTAGCTTTAA
GCAAGAGGGATTATGCCATTGCACTATTGGTTGGCAGTTTAATGGGTAAAGACAGATGGT
CTGAAGTCATTCAGAAATATTTATATGAAGGGTTTACTGCGGGGCCAAACGACCAAAAAG
AATTGGCACACTTTCTGCTCCTTATCTTTCAAGTATTTGTTGGTAACTCCAAAATGGCCA
TAAAAAGTTTCTACACTAATAATGAGACCAGTCAATGGGCATCCGAAACTGGAAGAGTA
TCGTTGCAGCTGTTCTGATTAATATCCCAGAAAATAATGAAGATCCACTACTTATACCAC
CTGTTGTCCTTGAATTTTTGATAGAGTTCGGTATATTCCTCACCAAAAAGGGCTTGACAG
CCGCAGCTAGTACATTATTTATTATTGGTAACGTACCACTTTCTAATGAGCCAGTAATGG
CAGATTCAGACGTTATATTTGAAAGTATTGGAAACATGAATACTTTTGAAAGCATTCTAT
GGGATGAAATCTACGAGTATATATTCTCGTATGACCCTAAATTCAAAGGATTTTCATCTA
TTTTGCCCCAGAAGATATACCATGCATCTCTTTTACAAGAACAAGGTTTGAACAGCCTGG
GGACAAAGTATACTGATTACCTCAGTTCCTCAGTTCGAAAACTGCCTAAGAAAGATATTT
TAACAATAAACCTCACTCGTGAATTGAGTGAGGTGGCTAGTAGGCTTTCCGAGTCTAATA
CAGGATGGCTTGCAAAACCAAAACTAAGCAGCGTATGGGTCAATTAGATAAATCCTTCA
ATAAATATATTGGTGGCGATGATATTGATGCATTGAATAAAAAAAATGATAAAAGAAAG
TTTTTGATGGGTTCACACCGGGATCTTCTGCCAATTCGTCAACTGTGGATCTCACCCAAA
CATTCACACCTTTCCAAGCTCAAGTTACTTCGCAAAGCTATGTGGATACTACAGCTCTTT
TGCATAATGCCCATAATGTACCAAGCCATAGTGTGCTGCATTCAAAGCCTTCCAATGTGT
CAAAGGGGTTAGTTGAAGCAAACTTACCGTATACGCATAGGATCGGTGATAGTTTGCAGG
GATCTCCTCAGCGCATTCATAATACACAGTTCGCTGCTGCTGAGCCTCAAATGGCTTCTT
TGAGAAGAGTTAGAACAGACCAGCATACAAACGAAAAGGCTTTGAAGAGTCAGCAGATTT
TAGAGAAAAGTCTACGGCCTACACTCCACAATTTGGACAGAACCATAGCGTTCCAATGG
AAAAGTCTAATTCGAATGTGCCATCTTTATTTGCCGACTTCCCTGCTCCACCCAAACTTG
GAACAGTGCCGTCTAATTATGTGTCTAGTCCTGACTTAGTAAGAAGGGAGTCTATCATAT
CTACCGGATCAGAATTTCTTCCTCCTCCCAAAATTGGGGTACCTACTAAAGCTAATTCCT
CGCAGGGATCGCTTATGTACTCACCAAGTGTGGAAGCTTTGCCTATCGACCCTGTCGTCC
CGCAAGTTCATGAGACGGGATACAATGATTTTGGTAACAAACATTCTCAAAAAGTATGC
CTGAAGATGAATCTCACACATCACATGATAATAGCAATGCTGATCAAAATACATTAAAAG
ACTCTGCAGATGTTACAGATGAAACAATGGATATTGAAGGACCTGGCTTCAACGATGTGA
AGAATCTTCTTCCTATGGAGCCCAACCACCAGCCTACGTCTACAGTAAATCCTATACAAA
CTATTAGTGACGATATCCAACCGATTCTTCAAACTAACGTGGAGGTCCGGGGTACTGATG
CATCGAAAATGGAAAATTCACTTCCCTCCATTGAAAATGAAAGAAGTAGCGAGGAGCAGC
CAGAAAACATTTCAAAATCAGCATCATCAGCATATTTACCATCAACTGGTGGATTGTCAC
TCGAAAACAGACCGCTAACTCAGGATGAAAACAGTATCTCAGAGACAGTTCAATCCACAT
ACTTGCCAGCAGGAAGTATTTCAATGGAAGCTAAACCAATTTCTCAAGTGCAAGATGTTC
CAAGAAATGTTAATAATAAAGCATCCAAACTTGTGGAGCAACATATGGCACCACCAAAGC
CAAAAAGTACTGACGCAACCAAAATGAACTACTCACCATACGTGCCTCAATCAACTGCCG
CTAGTGCAGATGGCGATGAATCAACGATTCTGAAAACATCGCCTGCTATATATGCAAGAA
CTCACCAAGCACATGCATCCAATCCATCACAATACTTTCCTTTGGTCAACCAAGCAAATG
AAACTGCTTCATTCGAATTATCTGAATCAACATCCCAGGCACAAAGTAATGGAAATGTTG
CTTCAGAAAATAGATTCAGCCCAATAAAGAAAGCCGAAGTCGTCGAGAAAGACACTTTTC
AACCTACTATTAGGAAGGCTTCAACTAACCAATACAGGGCTTTTAAACCGTTGGAATCAG
ATGCGGATAAATACAATGACGTTATTGAAGATGAATCCGATGACGACAATATGTCTACTG
ATGAGGCAAAGAACAGAAAGGAAGAAAAAAGAATGTGAATATGAAAAGGAAACAAAAC
CAAGTAACAAGGACATAGATGACAAGTCTAATGGTTGGTTTGGTTGGTTGAAGAAAGATA
CTGGCGACAAAAAAGTGTATAAGGCCAAGCTAGGTCATAAAAACACACTATACTATGATG
AAAAATTGAAACGTTGGGTGAATAAGGACGCAACCGAAGAGGAAAAACAAAAAATTATTG
AAAGTTCGGCACCACCACCTCCTCCAATCGTGAAACGTAAAGATGGCGGCCCAAAGACAA
```

AGCCACGTTCAGGCCCCATCAATAATTCCCTACCTCCAGTACATGCCACATCAGTTATTC
CGAACAATCCAATCACTGGTGAGCCTTTGCCGATCAAAACATCCCCTTCTCCTACAGGAC
CCAATCCAAACAATTCTCCATCACCATCCTCTCCCATATCAAGGATTTCTGGCGTAAACT
TGACTAGCAAAAAGGCAAACGGTTTGGATGATTTATTGAGTTTGGCAGGAGGACCCAAAC
CAGCAAGTACGAGAAGGAAGAAGAAAACAGCGAGAGGCTATGTTAATGTAATGGATAACA
TACAATAA

>YPL085W, 2195 aa (SEQ ID NO 384)
MTPEAKKRKNQKKKLKQKQKKAAEKAASHSEEPLELPESTINSSFNDDSVNRTESDIASK
SDVPPVSSSTNISPANETQLEIPDTQELHHKLLNDSDQHDITADSNDLPDNSIVEHDSVI
TQTKPAMSQEYEETAAHLSSRNPSLDVVAGELHNNNEHTQKIAVSAVEEDSFNEEEGENH
DSIIISSLNDATPSQYNHFLPSDGNLLSPELSSGDTPTHNVPLGTKDNEINDDEYCNDKE
ISLNANNVLPDELSKEEDERLKLETHVSTEEKKQDIADQETAENLFTSSTEPSENKIRNS
GDDTSMLFQDDESDQKVPWEEDVKKDFHNENTNNTQESAPNTDDRDKGYEGNEALKKSES
CTAADERSYSEETSEDIFHGHDKQVVEGQNDFTGKNIENESQKLMGEGNHKLPLSAEADI
IEPGKDIQDQAEDLFTQSSGDLGEVLPWESTDKNADVTSKSQEKHEDLFAASGNDEKLPW
EVSDGEVSSGKTENSMQTSTEKIAEQKFSFLENDDDLLDDDDSFLASSEEEDTVPNTDNT
TNLTSKPVEEKKASRYKPIIEEEAGMRQEQVHFTNTTGIVTPQQFHGLTKTGLGTPNQQV
SVPNIVSPKPPVVKDNRSNFKINEEKKKSDAYDFPLEIISESSKKGHAKPVAVPTQRFGS
GNSFSSLDKPIPQSRKGSNNSNRPPVIPLGTQEPRSSRTNSAISQSPVNYAFPNPYKIQQ
LQQAPIQSGMPLPNTNIPPPALKVETTVSAPPIRARGVSNASVGSSASFGARHATQYGLN
NGVPPVSPYGQATINLPTANKYAPVSPTVQQKQYPSVVQNLGASAVNTPNFVKTHRGHTS
SISSYTPNQNEHASRYAPNYQQSYQVPYTSQPVGPVAGNSSYQSQTRSSYAVPMMPQAQT
SASIQPHANIQPPTGILPLAPLRPLDPLQAATNLQPRASNITAANSLPLANLPLAENILP
EIITHRATSSVAPPRQENNPIKIDNEALLRRQFPIFHWSAANKVVYAVPPIPDQSQYMIS
SSIVQEIKVTPIDQIIKPNDMLKSFPGPLGSAKLKKKDLTKWMETTIKSISENESSTDMT
IWQLLEMKLNDKVNWKNISKLLYNSDELLMYLSQPFPNGDMIPNAYRLDINCQMRVLAFL
QTGNHDEALRLALSKRDYAIALLVGSLMGKDRWSEVIQKYLYEGFTAGPNDQKELAHFLL
LIFQVFVGNSKMAIKSFYTNNETSQWASENWKSIVAAVLINIPENNEDPLLIPPVVLEFL
IEFGIFLTKKGLTAAASTLFIIGNVPLSNEPVMADSDVIFESIGNMNTFESILWDEIYEY
IFSYDPKFKGFSSILPQKIYHASLLQEQGLNSLGTKYTDYLSSSVRKLPKKDILTINLTR
ELSEVASRLSESNTGWLAKPKLSSVWGQLDKSFNKYIGGDDIDALNKKNDKKKVFDGFTP
GSSANSSTVDLTQTFTPFQAQVTSQSYVDTTALLHNAHNVPSHSVLHSKPSNVSKGLVEA
NLPYTHRIGDSLQGSPQRIHNTQFAAAEPQMASLRRVRTDQHTNEKALKSQQILEKKSTA
YTPQFGQNHSVPMEKSNSNVPSLFADFPAPPKLGTVPSNYVSSPDLVRRESIISTGSEFL
PPPKIGVPTKANSSQGSLMYSPSVEALPIDPVVPQVHETGYNDFGNKHSQKSMPEDESHT
SHDNSNADQNTLKDSADVTDETMDIEGPGFNDVKNLLPMEPNHQPTSTVNPIQTISDDIQ
PILQTNVEVRGTDASKMENSLPSIENERSSEEQPENISKSASSAYLPSTGGLSLENRPLT
QDENSISETVQSTYLPAGSISMEAKPISQVQDVPRNVNNKASKLVEQHMAPPKPKSTDAT
KMNYSPYVPQSTAASADGDESTILKTSPAIYARTHQAHASNPSQYFPLVNQANETASFEL
SESTSQAQSNGNVASENRFSPIKKAEVVEKDTFQPTIRKASTNQYRAFKPLESDADKYND
VIEDESDDDNMSTDEAKNRKEEKKNVNMKKETKPSNKDIDDKSNGWFGWLKKDTGDKKVY
KAKLGHKNTLYYDEKLKRWVNKDATEEEKQKIIESSAPPPPPIVKRKDGGPKTKPRSGPI
NNSLPPVHATSVIPNNPITGEPLPIKTSPSPTGPNPNNSPSPSSPISRISGVNLTSKKAN
GLDDLLSLAGGPKPASTRRKKKTARGYVNVMDNIQ

>YPL190C, 2909 bp, CDS: 501-2909 (SEQ ID NO 387)
TAATCTTCGCTACTTCAAGTTTCATAATCAATCGACTTTCTGTATGGGTAAGCATCTGGT
GTGATGCAGTTTCATTATGACACCACAAATACAAAGAGACTATTTAAATATGTATATAG
ATCACATTCCAAAAAGAAAACCATTAATAATATCACTCTTTAATATTCCAAATTGAAAC
GAAAAAGCGCTATTCTTATTCGCTTCCTAACTACCGCCCTAGTTCGTGCTTGCATTTTTT
TGTAGAACGATAAATTATGGTATCCCACGTGATTGAGTGTAACCCTGAATTGTTGAAGAG
AAAATGAAGCGGAAGAAGCAAAGGACAAAAACAATTCATTTGATTTTGCCACTTCTAAA
TGAAGGTCTAATAAAAGCTATCTTGAGCATCTTTATTAGATTCTGCACAGCAACAAGCGA
TTTTCTTTGGTCAAAATATAATAATTGACTTACGTTTTTCCCGGACTGTCCTTTCATAAT
ATAATAACCATCTGCAAGCCATGTCAGATGAAAACCATAACAGTGATGTTCAAGATATTC

```
CTTCACCTGAACTATCCGTCGATAGTAACTCTAACGAGAATGAATTGATGAATAACTCAA
GCGCAGACGATGGAATCGAATTTGACGCCCCAGAGGAAGAAAGAGAAGCCGAAAGGGAGG
AGGAAAATGAAGAACAACACGAACTGGAAGATGTGAACGATGAAGAGGAGGAAGATAAGG
AGGAAAAAGGAGAGGAAAACGGGGAAGTAATAAACACAGAAGAAGAAGAAGAAGAAGAAC
ATCAACAAAAGGCGGAAATGATGATGACGATGATGATAATGAAGAGGAAGAAGAGGAAG
AAGAGGATGATGACGATGATGATGATGACGACGATGATGATGAAGAAGAAGAAGAAGAAG
AAGAAGAAGAAGGCAACGACAACAGTTCGGTAGGCTCAGATAGTGCCGCTGAAGACGGTG
AGGATGAGGAAGACAAAAAGGATAAAACCAAAGATAAAGAGGTCGAACTTCGCCGTGAAA
CATTGGAAAAAGAACAAAAGGACGTAGATGAAGCTATAAAAAAAATAACTCGTGAAGAAA
ATGATAATACTCACTTTCCAACTAATATGGAAAATGTTAATTACGATCTTTTACAAAAGC
AAGTCAAGTACATTATGGACAGTAACATGCTAAATTTGCCTCAGTTTCAACATTTACCTC
AAGAAGAAAAGATGTCTGCGATTTTAGCAATGTTAAATTCAAATTCTGACACAGCTCTTT
CCGTACCTCCTCATGATAGTACTATCTCAACAACAGCTAGCGCCTCAGCCACAAGCGGCG
CAAGAAGCAATGATCAAAGAAACCTCCATTGTCAGATGCCCAAGACGTATGAGATTTC
CTAGGGCGGATTTATCTAAGCCGATTACCGAAGAAGAACACGACCGTTATGCAGCCTATT
TGCACGGTGAAAATAAAATCACCGAGATGCACAATATTCCTCCGAAGTCAAGATTATTCA
TTGGTAATTTGCCGCTAAAGAACGTTTCTAAGGAGGATTTATTTAGGATTTTCTCTCCAT
ACGGTCATATCATGCAAATCAATATCAAAAATGCCTTTGGATTCATTCAGTTTGACAACC
CTCAAAGCGTTAGAGATGCAATTGAATGCGAGTCTCAAGAAATGAACTTTGGCAAAAGT
TGATCCTGGAAGTTTCTAGCTCGAATGCTCGTCCTCAATTTGATCATGGTGATCACGGTA
CAAACAGTAGTTCTACTTTTATTTCTTCCGCAAAACGACCATTTCAAACTGAATCTGGTG
ACATGTACAATGACGACAATGGTGCTGGCTACAAGAAATCCAGAAGACACACCGTTTCTT
GCAACATTTTCGTTAAAAGAACCGCAGATCGTACGTATGCCATTGAGGTTTTCAACAGGT
TTAGGGACGGGACTGGTTTGGAAACTGATATGATTTTCTTGAAACCAAGAATGGAACTGG
GAAAGCTTATCAATGATGCCGCATATAATGGGGTGTGGGCGTTGTTTAGTTAATAAAA
CACACAATGTAGATGTTCAAACTTTCTACAAAGGCTCACAAGGTGAAACGAAATTTGATG
AATATATTAGCATATCCGCTGATGACGCAGTTGCCATTTTTAATAACATCAAAAACAACA
GAAATAATTCTCGTCCTACTGATTACCGTGCTATGAGCCATCAGCAAAACATATATGGCG
CTCCTCCTCTTCCTGTTCCAAACGGCCCAGCTGTCGGACCTCCTCCTCAAACAAACTATT
ACCAGGGTTACAGTATGCCTCCTCCACAACAACAACAGCAACAGCCATATGGTAATTATG
GGATGCCACCACCATCCCATGACCAAGGATATGGTTCTCAACCTCCAATTCCAATGAATC
AGAGCTACGGTCGCTACCAGACTTCTATTCCACCACCACCTCCACAACAACAAATTCCTC
AAGGGTATGGTCGTTATCAGGCTGGTCCGCCTCCTCAACCACCTTCTCAAACTCCAATGG
ACCAGCAACAACTATTATCTGCCATTCAAAACCTTCCACCTAACGTTGTATCGAATTTGC
TTTCAATGGCCCAACAACAGCAACAACAACCTCATGCTCAGCAGCAATTGGTTGGTTTAA
TACAATCAATGCAAGGCCAGGCTCCTCAACAACAGCAACAACAGTTGGGTGGATATTCCT
CTATGAACTCATCCTCTCCCCCTCCTATGAGTACCAATTACAATGGTCAAAATATATCTG
CAAAACCCTCTGCCCCACCAATGTCACACCAACCTCCGCCACCTCAACAACAACAACAAC
AACAACAACAGCAACAGCAACAGCAACAGCAACCTGCTGGCAATAATGTTCAAAGTCTAT
TAGATAGTTTAGCAAAACTACAAAAATAG

>YPL190C, 802 aa (SEQ ID NO 388)
MSDENHNSDVQDIPSPELSVDSNSNENELMNNSSADDGIEFDAPEEEREAEREEENEEQH
ELEDVNDEEEEDKEEKGEENGEVINTEEEEEEEHQQKGGNDDDDDNEEEEEEEEDDDDD
DDDDDDDEEEEEEEEEEGNDNSSVGSDSAAEDGEDEEDKKDKTKDKEVELRRETLEKEQK
DVDEAIKKITREENDNTHFPTNMENVNYDLLQKQVKYIMDSNMLNLPQFQHLPQEEKMSA
ILAMLNSNSDTALSVPPHDSTISTTASASATSGARSNDQRKPPLSDAQRRMRFPRADLSK
PITEEEHDRYAAYLHGENKITEMHNIPPKSRLFIGNLPLKNVSKEDLFRIFSPYGHIMQI
NIKNAFGFIQFDNPQSVRDAIECESQEMNFGKKLILEVSSSNARPQFDHGDHGTNSSSTF
ISSAKRPFQTESGDMYNDDNGAGYKKSRRHTVSCNIFVKRTADRTYAIEVFNRFRDGTGL
ETDMIFLKPRMELGKLINDAAYNGVWGVVLVNKTHNVDVQTFYKGSQGETKFDEYISISA
DDAVAIFNNIKNNRNNSRPTDYRAMSHQQNIYGAPPLPVPNGPAVGPPPQTNYYQGYSMP
PPQQQQQQPYGNYGMPPPSHDQGYGSQPPIPMNQSYGRYQTSIPPPPPQQQIPQGYGRYQ
AGPPPQPPSQTPMDQQQLLSAIQNLPPNVVSNLLSMAQQQQQQPHAQQQLVGLIQSMQGQ
APQQQQQQLGGYSSMNSSSPPPMSTNYNGQNISAKPSAPPMSHQPPPPQQQQQQQQQQ
QQQQPAGNNVQSLLDSLAKLQK
```

>YPL201C, 1886 bp, CDS: 501-1886 (SEQ ID NO 389)
ATTTCATCACTTCATTAGTTATAAAAAGGAGTTCCCATTGCAGGAGAAAATAATCATTGT
TTATTGTCGCTAATTTTCTTTCCAATAACGATAACTGCAGTTTCCATTTCCAGGTCGCCA
ATTGGTTGGACAACGTTGATGTTACCTTCCTTGTTATGGAACCATCCATCATTTTCTAGT
TCTTCTTCTGCAATATTGCCTTTTGGGAAGAAGGATCGAAAGTAGCCATTTGCAGACACG
TTTTTACTATATTTACTGTATCTTCGATTGCGCGGCTAAAGTTGCCATATTATTATTATA
TTGCAGCTCAACCCCGCATTTCCGGAGTTTTCTTTTTTTTTATTTGGGGTAATTTGGAGG
TCGGCGGCTATTGGTGGGCCGGAAATGGTGACACACTTGTAATATATAAGGAGGAAATCC
TACATGTGTATAAGCGAAATCACAAGGATAATAATGTATTGCTAAACACCCTCAAGAAAG
AAAATAATCATAACGAAATCATGGGTATACCTATGCAAATATACCAGGATGGGAAGGGGG
TGCAATTTTACCACACGAGATATCAGAACGTATTTGACGAACGGGCGAGCAAGTATGGCA
ACTACACGGTGAATAATGATTACCCACAGCTTCCAGATACGATAAAGGAACATATCGACC
AGCTTACCTTTAGCAATGTCGGAGAGGATGGTGGAGATGTTGGAAACTATTCTGAAGAAG
ACGATGATGGTGACGAAGAAAAGGAACTTGAAGATGTTTTTCGAAGTAACCGTGGGTTGG
AATTTGTACGGATTAATAACTATTTTACTACCCACGATTTACAAAGTTTCAAAAGTTTTA
GAAATTTCAATAGCAAGTACTGGATTTTTTATTCTAATCAAGCAGAGGACAAAAAATTAC
TGCTGTATGACTTTAACGGCCAACATTTGATTTTTATTAAGCAGCAATTTTACGGGCAGT
TGAATTTACTGCTATCGGACGCAATAATATGTATGGACTGCAATTTTGGTTATAATTCAA
ACACCATTCAAATTTTAGTTGGATTTCAGAATGGAAAGTTGTTAAAGCTAAACTGCGACT
TGAACGGAAACGTAAACAATCACTTGCTTTTGAAGGATCCTTCAACTTCCTCTCATCAAA
GCCACCTATCTATATTAAATGTCTGGGCAGGTTTGTTGCCACATTTCGTTGTTTCTTTTA
GTTTGAAAGATGGGCTGCTAATAACTTCTTTAGATCACCAACAAAGCAATGGAAGTTTTC
AAAGTTTCCATACCAACATTGATTTGCCTGTAGATCTACGCACGACCACAAATGTCAAGT
CCGTTTTAAATTTCCCTCAGTTTACTTTATACAAAGGAAATGATATGATTTTCCACTGCA
AGAATCTATTAGGATCGGATGCTTCCACGCTAAACAAGGAAATAAACTTTATGCTTAAAA
TAGACGAAGACGTTCAAAAGATCGACTATCTTCTTAAAACGAATCACATTTTACTCGAAA
CCAACATGAGATATCTGTCCATTCCAACAAGAGACCCCATAGAGAATTCAAATTCTTCTC
CACCCGTCTCAGACAGCGAGGTTTATCCAATATTTTACAAGACACAAGAACTTCATGTCC
ATGCTTCAGGAACAGGACGTCAGATAGCAAACAATGGGAAGTATATTTTTATAACCGAGC
AACATCTCTACGGAACAGCGTTATCGGTATACAAGTACTCTATATCTTTCAAACGGTGGC
TGTTCGTGGGCTACTCAGACATTAGGGCCAAATACGGTATAAGGAGTGTCAAAGATCTCT
TTGTTGGTAACTGTCCCTCTGTAAATAGCCCAGTGCTGACAATTCTTACTGATGACAATA
ACATTCAAACAATTCTTCTTAAATAA

>YPL201C, 461 aa (SEQ ID NO 390)
MGIPMQIYQDGKGVQFYHTRYQNVFDERASKYGNYTVNNDYPQLPDTIKEHIDQLTFSNV
GEDGGDVGNYSEEDDDGDEEKELEDVFRSNRGLEFVRINNYFTTHDLQSFKSFRNFNSKY
WIFYSNQAEDKKLLLYDFNGQHLIFIKQQFYGQLNLLLSDAIICMDCNFGYNSNTIQILV
GFQNGKLLKLNCDLNGNVNNHLLLKDPSTSSHQSHLSILNVWAGLLPHFVVSFSLKDGLL
ITSLDHQQSNGSFQSFHTNIDLPVDLRTTTNVKSVLNFPQFTLYKGNDMIFHCKNLLGSD
ASTLNKEINFMLKIDEDVQKIDYLLKTNHILLETNMRYLSIPTRDPIENSNSSPPVSDSE
VYPIFYKTQELHVHASGTGRQIANNGKYIFITEQHLYGTALSVYKYSISFKRWLFVGYSD
IRAKYGIRSVKDLFVGNCPSVNSPVLTILTDDNNIQTILLK

>YPR028W, 1176 bp, exon1: 501-551, intron1: 552-684, exon2:
685-1176 (SEQ ID NO 393)
ACAAACCCTGTCAATCTCCTGAAAAACAAAAATTAAGTGCTTGAGAAGACCTTCAGAAGA
GTTGCATAGATAGGATGGGTGAGCGCAATTACTAGTTACGCAGTAAGTAGGTTATATGGC
TGCTGGAGGGGCAGTACTGATTTAATCACAATCCGGATTAAACTTCCTCCTGAAAAAAAA
AAAACTACATCAAGTCAAAAGATTTTCATTCACTCTTTGGAAGGCTGTGTGGCATTCTAA
CCTTTATTTTTTTATCACCATTCTCGAATTTTCGTGGTTCGCTTTCTTAGCGCCGTTATT
CTCTCTTCTTGTCCACGTCAAAGGGAGTATGCGTAACCCCTTTCAAGGTTGAACGAAAAA
AAAAAAATATGTCCTTCAAAATTTTTTTTGATTTAAAACTAAAAAACATTCCCTTGAAG
CTTGTTATTCCGAAAGAAAGAATCTAAAATTGCAATTGGTAGTGAAAACAAATAAACAAA
GACATAACCGCACTCCAATCATGTCCGAATATGCATCTAGTATTCACTCTCAAATGAAAC
AATTCGATACCGTATGTAAGATGGTTTTATTGGTTCCATCGTCATCATGGTTCAAACAGC

```
CAAATGACCCGACACACGTAACCGAAGCAGTTATACTAACAAGAAAGCTAATTTTCACCC
TCCTTGCTACATTTTTTCTACAGAAGTACTCTGGTAATAGAATTTTACAGCAATTAGAA
AATAAAACTAATTTGCCTAAATCTTATTTAGTTGCTGGTTTAGGTTTCGCTTATCTCCTT
TTGATTTTTATTAACGTCGGAGGTGTAGGTGAAATTCTTTCCAATTTTGCTGGGTTTGTG
TTGCCAGCATATTTATCGTTGGTTGCTTTGAAGACACCAACGTCCACCGATGACACACAA
CTCTTGACCTACTGGATTGTCTTTTCATTTTTGAGTGTCATTGAATTCTGGTCCAAGGCA
ATTCTATATTTGATTCCATTCTACTGGTTTTTGAAAACCGTTTTCTTAATCTACATTGCC
TTGCCTCAAACTGGTGGCGCTAGAATGATCTATCAAAGATCGTAGCCCCATTGACCGAC
AGATATATCCTAAGAGATGTTAGCAAGACAGAAAAGGATGAAATTAGAGCTTCCGTCAAT
GAGGCTTCTAAGGCTACAGGTGCTTCTGTTCATTAA
```

>YPR028W, 180 aa (SEQ ID NO 394)
MSEYASSIHSQMKQFDTKYSGNRILQQLENKTNLPKSYLVAGLGFAYLLLIFINVGGVGE
ILSNFAGFVLPAYLSLVALKTPTSTDDTQLLTYWIVFSFLSVIEFWSKAILYLIPFYWFL
KTVFLIYIALPQTGGARMIYQKIVAPLTDRYILRDVSKTEKDEIRASVNEASKATGASVH

```
YDR145W, 2120 bp, CDS: 501-2120 (SEQ ID NO 99)
AAGTGATTATCTGAATAATGAAAGATGGTAGGAAATAAGGTATTGAAACA
GGTTCAAAACTTTAAAAGAAAACTGCCAAATAAACTTTCTCGATGCGTAG
CTGAAATTTCAACTTCAAAAAAAAAAAAACGCGTGTAACTTTCTACGTGC
AAAACGATGTGTATGAATCCCGTCTTAATTAGTAAATAGGGTCTAGTAAG
CGTAGCGAGGATGAATTAAATGCATTGTTGAATATGAAGAGCACCTTATG
GTATATAAATGTACAATCTTGATTCATGACAGCTTTGCAAGTAAACGTAT
CAAATGAATATCACGATTTTGGCTGTATTACCCGGGCAGTATACGCGGCG
AATTTTGTTAAAAAATGTGTTAGACTTAAGTCGGAGCAAATGAATAATGG
GCATATATAGCGCATAGGTTCGCTAGTGTAAGACAGGAGACTGTCCAATA
GCATTCGAATCATAACCGAATCTTTGCCAGTGTGTGTATAAAATACGACA
ATGTCTTCCAATCCAGAAAATTCTGGTGTTAATGCGAATAATAATACGGG
CACTGGTAACGCTGATGCGATCACAGGAGCTCAGCAAAATATGGTACTGC
AACCGAGACAGTTGCAAGAAATGGCCGCTAAGTTCAGGACATTACTGACT
GAAGCAAGAAATGTAGGTGAAACTACTCCTAGGGGCAAGGAATTGATGTT
CCAAGCCGCAAAGATCAAACAGGTATATGATGCCCTTACACTGAATAGGA
GAAGACAACAGGCTGCGCAAGCCTACAATAATACTTCAAATTCAAATTCA
AGCAATCCAGCTTCTATTCCTACTGAAAATGTCCCTAATTCATCACAGCA
ACAACAACAACAACAACAGACAAGAAACAACAGTAACAAATTTAGCA
ATATGATAAAACAGGTTCTCACCCCGGAAGAGAACCAAGAATATGAAAAG
CTATGGCAGAATTTCCAAGTCCGTCATACGAGTATAAAGGAGAAAGAGAC
CTACTTGAAACAAAATATTGATAGGTTAGAACAAGAAATAAATAAACAGA
CGGACGAAGGGCCCAAGCAGCAGCTACAAGAAAAGAAAATTGAACTGCTT
AACGATTGGAAGGTGCTAAAAATTGAGTATACCAAGCTGTTCAATAATTA
TCAAAACAGTAAAAAACATTCTATGTAGAGTGTGCAAGACACAATCCGG
CTTTACATAAATTCTTGCAAGAAAGCACTCAACAGCAACGAGTGCAGCAA
CAAAGGGTACAACAACAACAACAACAACAGCAGCAGCAGCAACAGCA
GCAACAGCAACAGCAACAGCAACAGCAACGCCAGGGTCAAAACCAAAGAA
AGATTTCTAGTTCTAATTCTACTGAAATACCCTCTGTAACCGGCCCTGAT
GCACTGAAATCGCAGCAGCAGCAGCAGAATACAATAACTGCCACCAATAA
TCCCAGGGGCAATGTTAACACTTCACAGACTGAACAATCGAAAGCTAAGG
TAACCAATGTAAATGCAACGGCATCTATGTTGAATAATATAAGTTCGAGC
AAATCGGCAATATTCAAACAAACAGAGCCTGCCATACCCATATCGGAAAA
TATATCTACCAAAACACCAGCACCGGTAGCTTATAGATCCAACAGACCTA
CAATAACTGGAGGTTCTGCTATGAATGCCAGTGCTTTGAATACACCAGCA
ACAACTAAATTACCACCCTATGAAATGGATACTCAGAGAGTTATGTCAAA
GCGTAAATTAAGAGAGTTAGTGAAGACTGTCGGAATTGATGAGGGTGACG
GTGAAACTGTCATTGACGGTGATGTTGAGGAATTACTATTGGATCTTGCC
GACGATTTTGTTACTAATGTTACAGCTTTTTCTTGTAGATTGGCAAAACA
CAGAAAATCGGACAATTTGGAGGCAAGAGACATTCAGTTACATTTGGAGA
```

GAAATTGGAATATTAGGATTCCTGGTTATTCCGCAGACGAAATAAGAAGT
ACAAGAAAATGGAATCCCTCTCAAAATTATAACCAGAAATTGCAGAGTAT
CACATCAGATAAGGTAGCAGCTGCAAAAAACAATGGAAACAATGTTGCAA
GCTTGAATACAAAAAAATAA

YDR145W, 539 aa (SEQ ID NO 100)
MSSNPENSGVNANNNTGTGNADAITGAQQNMVLQPRQLQEMAAKFRTLLT
EARNVGETTPRGKELMFQAAKIKQVYDALTLNRRRQQAAQAYNNTSNSNS
SNPASIPTENVPNSSQQQQQQQQQTRNNSNKFSNMIKQVLTPEENQEYEK
LWQNFQVRHTSIKEKETYLKQNIDRLEQEINKQTDEGPKQQLQEKKIELL
NDWKVLKIEYTKLFNNYQNSKKTFYVECARHNPALHKFLQESTQQQRVQQ
QRVQQQQQQQQQQQQQQQQQQQQQQRQGQNQRKISSSNSTEIPSVTGPD
ALKSQQQQQNTITATNNPRGNVNTSQTEQSKAKVTNVNATASMLNNISSS
KSAIFKQTEPAIPISENISTKTPAPVAYRSNRPTITGGSAMNASALNTPA
TTKLPPYEMDTQRVMSKRKLRELVKTVGIDEGDGETVIDGDVEELLLDLA
DDFVTNVTAFSCRLAKHRKSDNLEARDIQLHLERNWNIRIPGYSADEIRS
TRKWNPSQNYNQKLQSITSDKVAAAKNNGNNVASLNTKK

YDR216W, 4472bp, CDS: 501-4472 (SEQ ID NO 109)
CAAAGAACAACGCCTTAAAAATAGGAAAACGTTTTCGCTACAGGTGTTGT
TATTATTGTTGTTGTGCTGTTGTTTATTGTGCTATACTTGTGGTATTTAT
TCTGGACTTCCGATCGGAAATTTTCTTCCCTTGAAGACCTTTTGAAGACA
ACAGTTATATATCATTGATCTGAATTTCTCAGGCTATTTTCAAAATTCCA
TACCTCCTTATTCCAACATTTGCTCGACTACTATAGAAAAGCCTTATTCT
TTTATCTTTGAAAGAAAGAAAAGGTGTCATAGCAAAAGTTTATTGTTACT
CTGTTTTGATATACTCCCTCTTATTCGTTGGAAGTATAAGATTGATTTGC
ATAAATTAACCAATCATTTTGCTACTTTCCGGTTCTCCCTTTATTATAA
ACACTTCAGAAAAATATTCTGCTACTATTCCTTACTTTACTATAAGAATT
TTGTTTTCCAAAAAAAAAAATATAAAAAAAATAATCATACTCTATTACT
ATGGCTAACGTAGAAAAACCAAACGATTGTTCAGGCTTTCCCGTTGTTGA
CTTGAATTCGTGCTTTTCTAACGGCTTCAATAATGAGAAACAAGAAATAG
AAATGGAAACGGATGATTCACCGATTTTATTAATGTCATCATCAGCTTCC
AGAGAAAACTCAAACACTTTCTCTGTGATACAGAGGACGCCAGATGGAAA
GATCATTACCACAAATAATAATATGAACTCCAAGATTAACAAGCAACTGG
ACAAGTTGCCCGAAAATTTAAGGCTTAATGGTAGAACCCCCAGTGGGAAA
CTAAGGTCATTTGTTTGCGAGGTTTGTACGAGAGCGTTCGCAAGACAAGA
GCACTTGAAAAGACATTACAGATCGCATACAAATGAAAAACCTTATCCCT
GTGGCCTCTGCAACAGATGCTTTACTAGGAGGGACTTACTGATCAGGCAT
GCTCAAAAAATCCATAGTGGTAATTTAGGGGAAACGATTTCCCATACCAA
GAAAGTGTCGAGAACTATAACTAAAGCTCGGAAAAATTCTGCATCCTCAG
TCAAGTTTCAAACTCCAACCTATGGTACTCCAGATAATGGTAATTTTTTG
AATCGCACTACTGCCAATACAAGAAGAAAAGCAAGCCCTGAAGCTAATGT
TAAACGTAAGTACTTGAAAAAACTGACGCGCAGGGCTTCATTTAGCGCAC
AATCAGCATCCAGCTATGCTTTGCCCGACCAATCTTCGCTAGAACAACAT
CCAAAGGATCGTGTTAAATTTTCTACGCCTGAATTAGTTCCACTTGACTT
GAAGAATCCTGAACTTGACTCTTCGTTTGACCTGAATATGAATCTAGATT
TAAACCTAAATCTAGATTCCAATTTCAATATAGCATTAAACCGTTCTGAT
TCTTCTGGATCAACAATGAATTTGGATTATAAATTGCCCGAATCAGCAAA
TAACTACACATATTCTTCCGGCTCACCAACCCGCGCATATGTCGGCGCTA
ACACGAATTCTAAGAACGCTTCATTTAATGACGCAGACTTATTGTCGTCG
TCGTACTGGATAAAAGCCTATAATGATCATTTGTTTTCAGTATCTGAAAG
TGATGAAACTTCTCCAATGAACTCTGAATTAAACGACACTAAATTAATCG
TCCCAGATTTTAAATCGACTATACATCATTTGAAGGATTCAAGGTCCTCC
TCTTGGACTGTTGCTATAGATAATAATAGCAATAACAATAAGGTATCAGA
CAACCAACCTGATTTCGTCGATTTTCAAGAACTGCTGGATAATGATACTT
TAGGTAATGATTTGTTAGAGACCACTGCCGTTTTAAAAGAATTTGAACTT

```
TTACATGATGATAGCGTAAGTGCTACCGCCACGTCAAATGAGATTGACCT
TTCCCATTTGAACCTATCAAACTCTCCAATTTCTCCTCATAAGTTAATTT
ATAAGAATAAAGAGGGGACCAATGACGATATGTTGATTTCTTTCGGACTC
GATCATCCTTCCAATCGCGAAGATGATCTGGATAAGCTATGTAATATGAC
CAGAGATGTTCAAGCCATATTCAGTCAATATTTGAAGGAGAAGAGTCTA
AACGATCCCTGGAAGACTTTTTATCAACGTCAAACAGGAAAGAAAAGCCA
GATAGCGGCAACTATACTTTTTATGGGTTAGATTGTTTAACGTTATCGAA
AATATCAAGAGCTCTGCCGGCCTCCACTGTGAACAACAATCAGCCATCGC
ATTCCATAGAATCAAAGCTATTTAATGAACCAATGAGAAATATGTGCATT
AAAGTGCTTAGATACTATGAAAAGTTCAGTCATGATAGTAGTGAGAGTGT
CATGGACTCTAATCCAAACTTGCTGTCCAAAGAATTGTTAATGCCAGCTG
TGAGTGAATTGAACGAATATTTAGATCTTTTCAAGAATAATTTCCTTCCC
CATTTCCCTATTATTCACCCAAGCTTGCTTGATTTGGATTTGGATAGCTT
GCAACGATATACTAATGAGGATGGGTATGATGACGCTGAAAACGCGCAGT
TGTTTGATCGATTAAGTCAAGGGACAGATAAAGAATATGATTACGAGCAC
TATCAAATCTTGTCCATTTCGAAAATCGTTTGTTTACCCTTATTTATGGC
CACATTTGGTTCTTTGCATAAGTTCGGTTACAAATCTCAAACAATAGAAT
TGTATGAGATGAGTAGAAGAATTCTACATTCTTTTTGGAGACTAAAAGA
AGGTGTCGCAGTACAACAGTAAATGACAGTTATCAGAACATTTGGTTGAT
GCAATCCCTAATATTGAGCTTCATGTTCGCTCTAGTTGCTGATTATTTGG
AGAAAATTGACTCCTCTTTGATGAAAAGGCAATTGTCCGCATTATGTTCA
ACGATCAGATCAAACTGTTTACCGACAATTTCTGCAAATTCTGAGAAGAG
TATCAATAATAACAATGAACCTTTAACATTTGGTTCTCCTCTTCAATACA
TCATTTTTGAGTCAAAAATTAGATGCACCTTAATGGCTTATGATTTTGT
CAGTTCTTGAAATGTTTCTTCCATATTAAATTCGATTTGTCTATAAAGGA
AAAAGATGTTGAAACCATTTATATTCCCGACAATGAGTCAAAATGGGCCA
GTGAATCGATAATATGTAATGGGCATGTTGTGCAAAAGCAAAATTTTTAT
GATTTTAGAAACTTTTATTACAGTTTCACGTATGGACACTTACACTCAAT
ACCAGAATTTTTAGGGTCATCTATGATTTATTATGAATACGATTTAAGAA
AAGGAACCAAATCACATGTGTTTTGGATCGAATCGATACGAAAAGGCTA
GAGAGGAGTCTTGACACTTCTTCCTATGGCAATGATAATATGGCAGCAAC
CAATAAAAATATTGCGATCTTAATTGATGACACCATAATTTTGAAAAATA
ATTTAATGTCAATGAGATTCATCAAACAGATTGATCGCTCGTTTACTGAG
AAGGTTAGAAAAGGACAAATAGCAAAGATATATGATTCCTTTTTGAACTC
TGTGAGGTTGAATTTTTTGAAGAATTATTCAGTTGAAGTATTGTGTGAAT
TTTTAGTAGCGTTGAACTTTTCAATCCGTAATATTTCGTCTTTATACGTA
GAAGAAGAAAGTGATTGCTCCCAAAGAATGAATTCTCCAGAGCTGCCAAG
GATCCACCTGAATAATCAAGCGCTTTCTGTCTTCAATTTACAAGGCTATT
ACTATTGCTTCATCCTAATTATCAAATTTTTATTGGATTTTGAAGCAACT
CCAAATTTTAAGTTACTGAGAATTTTTATTGAGTTGAGAAGCCTTGCGAA
TTCTATTTTACTTCCCACACTTTCAAGATTGTATCCGCAAGAGTTTTCTG
GATTTCCTGATGTTGTATTTACGCAACAATTTATAAATAAAGATAATGGT
ATGCTTGTCCCTGGTTTATCCGCAAATGAACACCATAATGGTGCAAGTGC
AGCTGTTAAGACTAAGTTAGCCAAAAAGATCAATGTTGAAGGGCTTGCAA
TGTTTATTAATGAAATCCTAGTTAACTCTTTTAACGATACCTCTTTTTTG
AATATGGAGGATCCTATTCGAAATGAATTTTCCTTTGATAATGGGGACAG
GGCAGTGACAGACTTGCCTCGTTCAGCACATTTCCTATCGGATACCGGCC
TAGAAGGTATTAACTTCAGCGGCTTAAATGATTCGCATCAAACTGTTTCT
ACTTTGAATCTTTTACGTTACGGGGAAAATCATTCATCAAAACATAAAAA
TGGTGGAAAGGGGCAAGGATTTGCCGAAAAGTACCAATTATCTCTGAAAT
ATGTTACTATTGCCAAGTTATTTTTCACCAATGTTAAAGAAAACTACATT
CATTGTCACATGTTAGATAAGATGGCAAGTGATTTCCACACTTTGGAAAA
TCATCTAAAGGGAAACAGTTGA
```

YDR216W, 1323 aa (SEQ ID NO 110)
MANVEKPNDCSGFPVVDLNSCFSNGFNNEKQEIEMETDDSPILLMSSSAS
RENSNTFSVIQRTPDGKIITTNNNMNSKINKQLDKLPENLRLNGRTPSGK
LRSFVCEVCTRAFARQEHLKRHYRSHTNEKPYPCGLCNRCFTRRDLLIRH
AQKIHSGNLGETISHTKKVSRTITKARKNSASSVKFQTPTYGTPDNGNFL
NRTTANTRRKASPEANVKRKYLKKLTRRASFSAQSASSYALPDQSSLEQH
PKDRVKFSTPELVPLDLKNPELDSSFDLNMNLDLNLNLDSNFNIALNRSD
SSGSTMNLDYKLPESANNYTYSSGSPTRAYVGANTNSKNASFNDADLLSS
SYWIKAYNDHLFSVSESDETSPMNSELNDTKLIVPDFKSTIHHLKDSRSS
SWTVAIDNNSNNNKVSDNQPDFVDFQELLDNDTLGNDLLETTAVLKEFEL
LHDDSVSATATSNEIDLSHLNLSNSPISPHKLIYKNKEGTNDDMLISFGL
DHPSNREDDLDKLCNMTRDVQAIFSQYLKGEESKRSLEDFLSTSNRKEKP
DSGNYTFYGLDCLTLSKISRALPASTVNNNQPSHSIESKLFNEPMRNMCI
KVLRYYEKFSHDSSESVMDSNPNLLSKELLMPAVSELNEYLDLFKNNFLP
HFPIIHPSLLDLDLDSLQRYTNEDGYDDAENAQLFDRLSQGTDKEYDYEH
YQILSISKIVCLPLFMATFGSLHKFGYKSQTIELYEMSRRILHSFLETKR
RCRSTTVNDSYQNIWLMQSLILSFMFALVADYLEKIDSSLMKRQLSALCS
TIRSNCLPTISANSEKSINNNNEPLTFGSPLQYIIFESKIRCTLMAYDFC
QFLKCFFHIKFDLSIKEKDVETIYIPDNESKWASESIICNGHVVQKQNFY
DFRNFYYSFTYGHLHSIPEFLGSSMIYYEYDLRKGTKSHVFLDRIDTKRL
ERSLDTSSYGNDNMAATNKNIAILIDDTIILKNNLMSMRFIKQIDRSFTE
KVRKGQIAKIYDSFLNSVRLNFLKNYSVEVLCEFLVALNFSIRNISSLYV
EEESDCSQRMNSPELPRIHLNNQALSVFNLQGYYYCFILIIKFLLDFEAT
PNFKLLRIFIELRSLANSILLPTLSRLYPQEFSGFPDVVFTQQFINKDNG
MLVPGLSANEHHNGASAAVKTKLAKKINVEGLAMFINEILVNSFNDTSFL
NMEDPIRNEFSFDNGDRAVTDLPRSAHFLSDTGLEGINFSGLNDSHQTVS
TLNLLRYGENHSSKHKNGGKGQGFAEKYQLSLKYVTIAKLFFTNVKENYI
HCHMLDKMASDFHTLENHLKGNS

YBR112C, 3401 bp, CDS: 501-3401 (SEQ ID NO 51)
GGGTGCCGTATCGGCTCTAATTATTTTATCTCTCTATTTTCTTTCTTTTC
TCTGCGCTACTCCTTTCTCGATCGTTGCTACTCCCGTCGCTAGCCACTGG
TCTCCCGCGTACTGTACTCCATCTTTTTTTGGCGTTTTTCCCCTATCCAA
CTCGAACAAGGTTTGTTTAAATTTATTTTATTTTTCTTTTCTTCGGTCGG
TCGTTCTTTTCCCTTCCGATTATCAAAGCAAAGCGCATTTTTTTCTTTG
TCTTTTTGTTTTTTGTTTCCTGTTCTCTGTTTTTTTACAAACCACGTCAG
GAGTTCAATTGAGAGAACTAGAATCAACAAAGCCAAATACGACAACGTCA
CTAGTCTTTGAACCAGAGGCGTATTCCCGTTACCTCTTTTCCCATATTTC
TGTTTTTCTTTTTCACTGCTATAAGCCTTTAGACTAGTACTACAACTACA
ACAGCAACAACAACAAACAAACACGACTGGAAAAAAAAAATTAGGAAAA
ATGAATCCGGGCGGTGAACAAACAATAATGGAACAACCCGCTCAACAGCA
ACAACAACAGCAACAACAACAGCAGCAACAGCAACAGCAGGCAGCAGTTC
CTCAGCAGCCACTCGACCCATTAACACAATCAACTGCGGAAACTTGGCTC
TCCATTGCTTCTTTGGCAGAAACCCTTGGTGATGGCGACAGGGCCGCAAT
GGCATATGACGCCACTTTACAGTTCAATCCCTCATCTGCAAAGGCTTTAA
CATCTTTGGCTCACTTGTACCGTTCCAGAGACATGTTCCAAAGAGCTGCA
GAATTATATGAAAGAGCACTTTTGGTAAATCCCGAACTATCAGATGTGTG
GGCTACTTTAGGTCATTGTTATCTGATGCTGGATGATCTGCAAAGAGCTT
ACAATGCCTATCAACAGGCTCTCTACCACCTCAGTAATCCCAACGTACCG
AAATTATGGCATGGAATCGGCATTCTTTATGACAGATATGGTTCGCTCGA
CTATGCCGAAGAAGCTTTTGCCAAAGTTTTGGAATTGGACCCTCATTTTG
AAAAGGCAAACGAAATTTACTTCAGACTAGGTATTATTTATAAACATCAG
GGTAAATGGTCTCAAGCTTTGGAATGCTTCAGATACATTCTCCCTCAACC
TCCTGCTCCCTTGCAGGAGTGGGACATATGGTTTCAGTTGGGTAGTGTTT
TGGAGAGTATGGGAGAGTGGCAAGGTGCGAAGGAAGCCTACGAGCATGTC
TTGGCTCAAAATCAACATCATGCCAAGTATTACAACAATTAGGTTGTCT

TTACGGTATGAGTAACGTACAATTTTATGACCCTCAAAAGGCATTGGATT
ATCTTCTAAAGTCGTTAGAAGCAGATCCCTCCGATGCCACTACATGGTAC
CATCTCGGTAGAGTGCATATGATTAGAACAGATTATACTGCCGCATATGA
TGCTTTCCAACAAGCTGTTAATAGAGATTCAAGAAACCCTATCTTTTGGT
GCTCAATCGGTGTTTTATATTACCAAATTTCTCAATACAGAGACGCCTTA
GACGCGTACACAAGAGCCATAAGATTAAATCCTTATATTAGTGAAGTTTG
GTACGATCTAGGTACTCTTTACGAAACTTGTAACAACCAATTATCTGACG
CCCTTGATGCGTATAAGCAAGCTGCAAGACTGGACGTAAATAATGTTCAC
ATAAGAGAAAGATTAGAAGCTTTAACAAAGCAGTTAGAAAACCCAGGCAA
TATAAACAAATCGAACGGTGCGCCAACGAATGCCTCTCCTGCCCCACCTC
CTGTGATTTTACAACCTACCTTACAACCTAATGATCAAGGAAATCCTTTG
AACACTAGAATTTCAGCCCAATCTGCCAATGCTACTGCTTCAATGGTACA
ACAACAGCATCCTGCTCAACAAACGCCTATTAACTCTTCTGCAACAATGT
ACAGTAATGGAGCTTCCCCTCAATTACAAGCTCAAGCTCAAGCTCAAGCT
CAAGCACAAGCTCAAGCACAAGCACAAGCTCAAGCACAAGCACAAGCACA
AGCGCAAGCACAAGCACAAGCACAGGCGCAAGCACAGGCACAAGCACAAG
CACAAGCACATGCACAAGCGCAAGCACAAGCACAAGCACAGGCACAAGCA
CAAGCACAGGCGCAGGCACAACAACAACAACAACAACAGCAACAACAACA
ACAACAACAACAACAACAACAACAACAACAACAACAACAACAACAACAAC
AGCAGCAGCAATTACAGCCCCTACCAAGACAACAGCTGCAGCAAAAGGGA
GTTTCTGTGCAAATGTTAAATCCTCAACAAGGGCAACCATATATCACACA
GCCAACAGTCATACAAGCTCACCAACTGCAACCATTTTCTACACAAGCTA
TGGAACATCCGCAAAGCTCTCAACTGCCACCTCAACAGCAACAACTACAA
TCTGTTCAACATCCACAACAACTTCAAGGCCAGCCTCAAGCCCAAGCTCC
CCAACCTTTAATCCAGCATAACGTGGAACAGAACGTTTTACCTCAAAAGA
GATACATGGAAGGTGCAATCCACACTTTAGTAGATGCCGCCGTATCCAGT
AGCACCCACACAGAGAATAACACAAAGTCTCCTCGTCAACCAACCCATGC
CATTCAACGCAAGCTCCGCAACAGGAATAACGAACGCTGAACCACAGG
TAAAGAAGCAAAAGTTGAACTCTCCAAATTCAAACATCAACAAATTAGTA
AATACTGCTACTTCCATTGAAGAAAATGCAAAATCTGAGGTGAGCAACCA
ATCGCCAGCAGTAGTGGAGTCTAATACCAATAATACTTCACAAGAAGAAA
AACCTGTAAAAGCAAACTCAATACCTTCAGTAATTGGCGCACAGGAACCT
CCACAGGAAGCTAGTCCTGCTGAAGAAGCTACCAAAGCAGCTTCTGTTTC
TCCTTCTACAAAACCGCTTAATACGGAACCAGAGTCATCTAGTGTCCAAC
CAACTGTATCATCAGAAAGTTCAACAACAAAAGCAAATGACCAAAGCACT
GCTGAGACCATAGAACTTTCTACTGCTACTGTTCCTGCAGAAGCAAGCCC
TGTAGAAGACGAAGTAAGACAGCATTCTAAAGAGGAAAACGGCACAACTG
AAGCATCTGCACCTTCTACTGAAGAGGCGGAGCCAGCAGCTTCCAGAGAT
GCTGAAAAACAACAAGATGAAACCGCTGCTACAACGATAACTGTAATCAA
ACCTACTTTGGAAACAATGGAAACAGTGAAAGAGGAGGCCAAAATGCGTG
AGGAAGAGCAAACATCTCAAGAAAAATCCCCACAGGAGAACACACTTCCA
AGAGAAAATGTAGTAAGGCAAGTGGAAGAAGATGAAAACTACGACGACTA
A

YBR112C, 966 aa (SEQ ID NO 52)
MNPGGEQTIMEQPAQQQQQQQQQQQQQQQAAVPQQPLDPLTQSTAETWL
SIASLAETLGDGDRAAMAYDATLQFNPSSAKALTSLAHLYRSRDMFQRAA
ELYERALLVNPELSDVWATLGHCYLMLDDLQRAYNAYQQALYHLSNPNVP
KLWHGIGILYDRYGSLDYAEEAFAKVLELDPHFEKANEIYFRLGIIYKHQ
GKWSQALECFRYILPQPPAPLQEWDIWFQLGSVLESMGEWQGAKEAYEHV
LAQNQHHAKVLQQLGCLYGMSNVQFYDPQKALDYLLKSLEADPSDATTWY
HLGRVHMIRTDYTAAYDAFQQAVNRDSRNPIFWCSIGVLYYQISQYRDAL
DAYTRAIRLNPYISEVWYDLGTLYETCNNQLSDALDAYKQAARLDVNNVH
IRERLEALTKQLENPGNINKSNGAPTNASPAPPPVILQPTLQPNDQGNPL
NTRISAQSANATASMVQQQHPAQQTPINSSATMYSNGASPQLQAQAQAQA
QAQAQAQAQAQAQAQAQAQAQAQAQAQAQAHAQAQAQAQAQA

QAQAQAQQQQQQQQQQQQQQQQQQQQQQQQQQQQQQQLQPLPRQQLQQKG
VSVQMLNPQQGQPYITQPTVIQAHQLQPFSTQAMEHPQSSQLPPQQQQLQ
SVQHPQQLQGQPQAQAPQPLIQHNVEQNVLPQKRYMEGAIHTLVDAAVSS
STHTENNTKSPRQPTHAIPTQAPATGITNAEPQVKKQKLNSPNSNINKLV
NTATSIEENAKSEVSNQSPAVVESNTNNTSQEEKPVKANSIPSVIGAQEP
PQEASPAEEATKAASVSPSTKPLNTEPESSSVQPTVSSESSTTKANDQST
AETIELSTATVPAEASPVEDEVRQHSKEENGTTEASAPSTEEAEPAASRD
AEKQQDETAATTITVIKPTLETMETVKEEAKMREEEQTSQEKSPQENTLP
RENVVRQVEEDENYDD

YMR043W, 1361 bp, CDS: 501-1361 (SEQ ID NO 305)
AAGCTGTGCCAAACAAGGTCATCTCCAAATACTTACCAAAAAGCTAGGGC
GTACTGTACTGGAATCTCTGCTTTTTTCTTTACCTTACTTCAATTTGCCT
TGTCTGCTTTTTTACGTGTGTTTTGGCGTTTCTGCTTTTCTTTTTTATTA
CTCGTTGTTGTAAATCATTTTCTAAGTATTATACATACTATATCATCGCA
TACCCAATCGGTTTCCTATTCTCACCACTTTTTTCTGGAAAAATACATAG
CCTAACAAGCAATTTTATTTTACGTTTGTTAATTCATTATACTGATAATA
TTTTTGAATTTTTTTTTTTTGATACATTTTTTTAATCGCTGTTTTGT
CTGTTTTTTTCGATTCAGTTATAGGGAAAAAAACGGGAAAGGAAAGAGAA
AAAAAAATTAGTGCAGAGCAATAAGAAGCGAAAATCAAAAAAAAGTTTTG
GATCTGCAAGACTTGCTGTCACGCAACAATATTATAGCCACCCAGCAAAA
ATGTCAGACATCGAAGAAGGTACGCCTACTAATAATGGGCAACAGAAGGA
GAGAAGAAAGATAGAAATTAAGTTCATCGAGAATAAAACAAGGCGCCATG
TGACATTTTCCAAAAGGAAGCACGGTATCATGAAAAAGGCGTTTGAGCTT
TCTGTTCTAACGGGGACCCAGGTCCTGTTGCTAGTCGTTTCAGAAACAGG
TTTGGTATATACTTTCAGCACGCCGAAGTTTGAACCTATAGTCACGCAGC
AGGAAGGTAGAAACCTGATCCAGGCCTGTCTTAACGCCCCTGATGATGAG
GAAGAAGACGAGGAGGAAGACGGTGATGATGATGATGATGATGACGATGA
TGGTAATGATATGCAACGCCAGCAACCACAACAACAGCAACCGCAACAAC
AGCAACAAGTATTGAATGCACACGCAAATAGCTTAGGCCATCTAAATCAA
GATCAGGTACCGGCAGGCGCGCTGAAACAAGAGGTGAAGTCACAATTGCT
AGGCGGTGCCAATCCTAATCAAAACTCAATGATTCAACAGCAGCAACATC
ACACGCAGAATTCACAACCACAACAGCAACAGCAACAACAACCACAGCAG
CAAATGTCACAGCAACAAATGTCACAGCATCCTCGACCACAGCAAGGAAT
ACCACATCCGCAACAATCGCAGCCACAGCAACAGCAACAACAACAACAAC
AACTGCAACAGCAGCAACAGCAGCAACAACAACAACCCCTCACCGGCATT
CATCAGCCTCACCAACAGGCTTTTGCCAACGCTGCCTCCCCTATCTGAA
TGCTGAACAGAATGCTGCCTACCAACAATACTTTCAAGAACCGCAACAAG
GCCAATACTAA

YMR043W, 286 aa (SEQ ID NO 306)
MSDIEEGTPTNNGQQKERRKIEIKFIENKTRRHVTFSKRKHGIMKKAFEL
SVLTGTQVLLLVVSETGLVYTFSTPKFEPIVTQQEGRNLIQACLNAPDDE
EEDEEEDGDDDDDDDDDGNDMQRQQPQQQQPQQQQQVLNAHANSLGHLNQ
DQVPAGALKQEVKSQLLGGANPNQNSMIQQQQHHTQNSQPQQQQQQQPQQ
QMSQQQMSQHPRPQQGIPHPQQSQPQQQQQQQQLQQQQQQQQQPLTGI
HQPHQQAFANAASPYLNAEQNAAYQQYFQEPQQGQY

YPL089C, 2531 bp, CDS: 501-2531 (SEQ ID NO 385)
TTCCACGTTCGCAAAAAATACTTCCACGGTGACGAAGTCTGTCTCAGTCG
TATATTAAATGCAGAAATCGTCTTATCATTATTGGGCTCTCTTAACGGCG
CAGCATCACCGGGTGATGAATGCCAAGCCGCAGAAAGAAAGAAAAAAATT
TACTTCAGATTTCTGATAAAAATAAAACGGAAGAGATGAAAGCTAATAAT
AGAAACAGCTCGATCTTCCTCTGAACAATAATAATTAAAGGACAGACAAA
AAGAAACGTAAGAAAGAAGCGAGCCTGTTCTAAAGTGTTCAACGACTGAT
TCAATTAGAACTGCCTACTCCTGATAGCCAACTCAACTTTTGACTCGTTA

```
AAGTAATTGAAAGCTGGCAAGCAGAATTATTCTTTTTTTTTTTCAAGGTT
TCTATCACGTTGTGAGGTTAATATCCCCGGAGCAAACAGGCTGAAGCGT
GAAAAAAACTTAAATATTAAAGTGTCGCAAAACTATACTATAGATACAAC
ATGGGTAGACGGAAGATTGAAATCCAGAGAATTTCTGATGACAGAAATAG
GGCTGTCACGTTTATAAAACGTAAAGCTGGCCTTTTTAAGAAGGCCCATG
AACTATCCGTTCTTTGTCAAGTAGACATAGCCGTCATTATACTGGGGTCC
AATAACACGTTCTATGAGTTTTCCTCTGTGGATACGAATGATTTAATCTA
TCACTACCAAAATGACAAAAACTTGCTTCACGAAGTGAAAGATCCTTCCG
ATTATGGAGACTTTCACAAAAGTGCATCCGTTAACATAAATCAAGACCTA
CTCAGGTCGTCTATGTCAAATAAGCCTTCGAAATCAAATGTTAAAGGAAT
GAACCAGTCAGAAAATGATGATGATGAGAACAATGATGAGGACGACGATG
ATCATGGCAATTTTGAGAGGAATTCAAATATGCATTCGAATAAAAAAGCC
TCTGATAAAAATATACCGAGTGCACACATGAAGTTGTTATCCCCGACCGC
ACTCATTTCAAAGATGGATGGTAGTGAGCAAAATAAACGTCATCCTGAGA
ACGCGCTGCCGCCTTTACAACATTTGAAAAGATTGAAACCGGATCCTTTG
CAAATAAGTAGAACTCCGCAACAGCAACAGCAGCAAAATATATCGAGACC
ATACCATAGTAGCATGTACAATCTTAACCAGCCTTCATCCAGTTCATCTT
CTCCTTCCACGATGGATTTTCCAAAATTACCAAGCTTTCAAAACTCTTCC
TTTAATGGTCGTCCTCCACCCATTTCCATTTCACCGAACAAGTTCAGTAA
GCCATTTACAAATGCATCCTCAAGGACCCCTAAACAGGAGCACAAAATTA
ACAATAGTGGCAGCAATAATAATGACAACAGCAACTACACTCAGTCACCA
TCTAATTCTTTGGAAGACTCTATTCAGCAGACTGTCAAAGCAAGAAGGAA
ATTGTCCGCCAGACCGGTACTTCGTGTGAGAATTCCGAACAACAATTTCA
GCAGTAATTCCGCTATTCCAAGTGAACCCTCCTCTGCCTCCTCCACATCG
GCCAACGGCAATAGTATGGGCTCTTCGCAGATAATGAAAGAAAACAAAAC
AAGTAGGTCTAGCAAAATTTCTCCACTATCCGCATCTGCCTCAGGCCCCT
TAACTCTCCAAAAAGGTAATAATGGCAGAATGGTAATAAAATTGCCAAAT
GCAAATGCGCCTAACGGTTCTAACAATGGTAATGGCAGTAACAATAACAA
TCACCCTTATCCTTTCGGAAGTGGGTCTTCACCTCTTTTTCTGCAACAC
AGCCATACATTGCCACTCCCTTGCAACCATCGAATATTCCTGGCGGACCT
TTCCAACAAAATACATCTTTTTTAGCTCAAAGACAAACCCAGCAATACCA
ACAAATGTCTTTCAAAAAACAGAGCCAAACAGTACCATTAACTACAACAT
TAACCGGACGCCCCCCTTCAACTTTTTCCGGCCCTGAAACCAGCAATGGC
CCTCCAACTGGTTCACTGCCATCGAAGTTCGTACATGATTTGATGAGTAA
TTCTCCAAATGTTTCTTCTATATCGATGTTTCCAGACTGGTCAATGGGAC
CCAACAGTGCCAAGCCGGGAAACACAAACAATCCTGGTACTTTCCCTCCC
GTACAGACGGCCGTAAACAACGGCAACTCCAGCAATATCAGCAGCACTAA
CAACACTAACAACAACAACAACAATAACAACAACAGCAGCAACAACA
ACAGCAACAACGGCAACGACAATAACAGTAACAATAGCAATAACAGTTAC
TATAGTAATAATGAAGATGCACCCGTAAATGGAGCTGCTATTTCAGAACA
TACTACCGATGGTGACTCGAACAATCAGTCCAACTCAAGTACATATGATG
CTGCTGCCACCGCATATAATGGAAATACCGGGCTGACTCCATACATAAAT
ACTGCTCAAACACCACTAGGCACTAAATTCTTTAATTTTTCGACTGATAT
TTCAGGAGAAAAAAATTCAAGCAAAATATAA
```

YPL089C, 676 aa (SEQ ID NO 386)
MGRRKIEIQRISDDRNRAVTFIKRKAGLFKKAHELSVLCQVDIAVIILGS
NNTFYEFSSVDTNDLIYHYQNDKNLLHEVKDPSDYGDFHKSASVNINQDL
LRSSMSNKPSKSNVKGMNQSENDDDENNDEDDDDHGNFERNSNMHSNKKA
SDKNIPSAHMKLLSPTALISKMDGSEQNKRHPENALPPLQHLKRLKPDPL
QISRTPQQQQQQNISRPYHSSMYNLNQPSSSSSSPSTMDFPKLPSFQNSS
FNGRPPPISISPNKFSKPFTNASSRTPKQEHKINNSGSNNNDNSNYTQSP
SNSLEDSIQQTVKARRKLSARPVLRVRIPNNNFSSNSAIPSEPSSASSTS
ANGNSMGSSQIMKENKTSRSSKISPLSASASGPLTLQKGNNGRMVIKLPN
ANAPNGSNNGNGSNNNNHPYPFGSGSSPLFSATQPYIATPLQPSNIPGGP
FQQNTSFLAQRQTQQYQQMSFKKQSQTVPLTTTLTGRPPSTFSGPETSNG

PPTGSLPSKFVHDLMSNSPNVSSISMFPDWSMGPNSAKPGNTNNPGTFPP
VQTAVNNGNSSNISSTNNTNNNNNNNNNNNSSNNNSNNGNDNNSNNSNNSY
YSNNEDAPVNGAAISEHTTDGDSNNQSNSSTYDAAATAYNGNTGLTPYIN
TAQTPLGTKFFNFSTDISGEKNSSKI

YOR372C, 2165 bp, CDS: 501-2165 (SEQ ID NO 371)
AAAATCGTGGTTACTTTCATATTCCTTAAACACTTTACCACTGTTACTGT
GCGCGTTCGAGCGTAGCTTTCGTGGTGAATTTATTGTAAGATTCTCCAGC
TGGCTCGATAGTTCTGCCTCCTGCGTATCCATATCCATTTCGGTATGCTT
TTACTATTCAACCTAGTCGGCAATTTTTTCACCTGAATATTGTTGAACAC
TTCTGGCATCCTAGATACTCATCTGTATTTATTCATTATCTGTTGTGCAT
CGTTAATAGCATTCCAGTAAACAAGTTTAGGTCACTACCCGCATAAGCCT
TTTGGCGTTTGGCGTAACCCTCCTCGCGAAAAGAAACGGGACGCAAAAAA
AAAAAACAACAAAACAAGAACAAAACAAAACAAATAGGACAGAGCCTTAA
GGAGCTGCAAGGATCTTCTGAATATTTGGCATCGGCATTGTGGGTGGAAA
AAGTGTCCAAATTGGAATAAATTGGTCAGAATAGAGCATTGATTCCAACT
ATGGACAGAGATATAAGCTACCAGCAAAATTATACCTCAACTGGGGCAAC
TGCAACTTCCTCAAGACAGCCCTCTACGGACAATAATGCAGATACAAATT
TTTTGAAGGTAATGTCAGAATTCAAATATAATTTTAACAGTCCGTTACCT
ACAACGACTCAATTCCCCACGCCCTATTCTTCTAATCAGTATCAACAGAC
TCAAGATCATTTTGCCAATACAGACGCTCACAACAGTTCGAGCAACGAAT
CGTCGTTGGTAGAGAACAGTATATTACCGCATCATCAGCAGATACAACAG
CAACAACAACAACAACAACAACAACAACAACAGCAAGCTCTAGGTTC
ACTTGTACCTCCTGCTGTCACAAGGACAGATACAAGTGAGACTTTGGACG
ATATCAACGTTCAACCTTCTTCTGTTTTGCAGTTCGGCAACTCTTTACCC
AGCGAATTTTTGGTTGCATCCCCAGAGCAATTCAAAGAATTTTTGTTGGA
CTCTCCGTCCACCAATTTCAATTTCTTTCACAAAACTCCGGCAAAGACAC
CACTTCGATTTGTAACAGATTCTAACGGTGCTCAGCAAAGCACCACAGAG
AACCCAGGTCAACAACAGAATGTTTTTAGCAATGTCGATTTGAACAATCT
TTTGAAGAGTAATGGAAAAACACCCTCATCTTCATGCACCGGCGCATTTT
CACGCACTCCTCTGAGTAAGATTGACATGAATCTCATGTTCAATCAACCG
CTGCCGACATCTCCATCAAAAAGGTTCTCCTCCCTGTCGTTGACACCATA
TGGAAGAAAAATTCTGAATGACGTCGGTACACCTTATGCAAAAGCATTGA
TATCGTCTAACAGCGCGTTAGTGGATTTTCAGAAGGCAAGAAAGGATATT
ACCACTAATGCAACATCCATAGGGCTGGAAAATGCCAACAACATCTTACA
GAGAACGCCGCTAAGATCTAACAATAAAAAATTATTTATTAAAACCCCCC
AGGATACCATCAATAGCACTAGCACACTAACTAAGGACAACGAAAATAAA
CAGGACATATACGGCTCTTCACCGACTACCATCCAATTAAATTCATCAAT
AACTAAATCTATCTCCAAATTGGATAACTCTAGAATTCCCTTGTTAGCTT
CGAGATCAGATAACATTCTGGATTCCAATGTGGATGACCAATTGTTTGAT
TTGGGGTTGACAAGATTACCTTTATCACCAACACCAAATTGTAATTCTTT
GCATAGTACAACCACAGGTACATCTGCCTTACAAATTCCTGAGCTACCCA
AGATGGGGTCTTTTAGAAGTGATACGGGAATCAATCCAATTTCAAGTTCA
AACACAGTTTCTTTTAAGAGCAAATCAGGCAATAATAATTCAAAGGGTCG
AATCAAAAAAATGGGAAGAAACCTTCCAAATTTCAAATTATTGTGGCAA
ATATTGATCAATTTAACCAGGATACATCATCGTCATCTTTATCATCATCA
TTGAATGCAAGTTCGAGTGCAGGGAATTCAAATTCAAACGTAACAAAGAA
AAGAGCAAGTAAACTCAAAAGATCACAGTCTTTACTTTCTGATTCCGGAT
CGAAATCACAAGCAAGGAAAGCTGTAATTCTAAATCTAATGGAAATTTA
TTCAATTCACAGTAA

YOR372C, 554 aa (SEQ ID NO 372)
MDRDISYQQNYTSTGATATSSRQPSTDNNADTNFLKVMSEFKYNFNSPLP
TTTQFPTPYSSNQYQQTQDHFANTDAHNSSSNESSLVENSILPHHQQIQQ
QQQQQQQQQQQQALGSLVPPAVTRTDTSETLDDINVQPSSVLQFGNSLP
SEFLVASPEQFKEFLLDSPSTNFNFFHKTPAKTPLRFVTDSNGAQQSTTE

NPGQQQNVFSNVDLNNLLKSNGKTPSSSCTGAFSRTPLSKIDMNLMFNQP
LPTSPSKRFSSLSLTPYGRKILNDVGTPYAKALISSNSALVDFQKARKDI
TTNATSIGLENANNILQRTPLRSNNKKLFIKTPQDTINSTSTLTKDNENK
QDIYGSSPTTIQLNSSITKSISKLDNSRIPLLASRSDNILDSNVDDQLFD
LGLTRLPLSPTPNCNSLHSTTTGTSALQIPELPKMGSFRSDTGINPISSS
NTVSFKSKSGNNNSKGRIKKNGKKPSKFQIIVANIDQFNQDTSSSSLSSS
LNASSSAGNSNSNVTKKRASKLKRSQSLLSDSGSKSQARKSCNSKSNGNL
FNSQ

YDR224C, 896 bp, CDS: 501-896 (SEQ ID NO 111)
TTTCTTCAACAACGACGAGTTAACTATTGTGCTCTTTTTTGAGCCACCA
AATACACTCCATTCCAATAGCTTCGCACAGTGAGGCGAAAATTTTGGAAC
AGCGCTAATGAATTATTTGTGAGCTCGGCGAGTTCAAATTTGAAGAAAAC
GCGGTTGGGTCGTTAACTATGGTTAGACGCTCAATGTCGCCCGAAAGGGA
AGGCTGTTCTCACTTTTTCGCGCGTTGCACCCTTTCTTCCGCGAAAAAAT
GAGAACGATGGATTTAAAATCAAGAGAATTGGCCTTAGTAGTGGCAAATA
CTACCTTGGTTGGTTATCTTGTAACGATTGGTAAGAAAGGGGCATCTCTG
TTTTCTTGATGTATATAAACAACATGATTTGATCATCTCAGATGGTCAGA
TTTATTAAAGACGTTTCTCTTTCCGCATTTTCGATTATTGTTATATTAAA
TTTATCCTATATAGACAAGTCAAACCACAAATAAACCATACACACATACA
ATGTCTGCTAAAGCCGAAAAGAAACCAGCCTCCAAAGCCCCAGCTGAAAA
GAAACCAGCCGCTAAAAAGACTTCCACTTCCACTGATGGTAAGAAGAGAA
GCAAGGCTAGAAAGGAAACATACTCTTCTTACATTTACAAAGTTTTGAAG
CAAACTCACCCTGACACTGGTATTTCCCAAAAGTCCATGTCTATCTTGAA
CTCTTTCGTTAACGATATCTTTGAAAGAATCGCTACTGAAGCTTCTAAAT
TGGCTGCGTATAACAAGAAGTCTACTATCTCTGCTAGAGAAATTCAAACC
GCTGTTAGATTGATCTTACCAGGTGAATTGGCTAAGCATGCTGTCTCTGA
AGGTACTAGAGCTGTTACCAAGTACTCTTCCTCTACTCAAGCATAA

YDR224C, 131 aa (SEQ ID NO 112)
MSAKAEKKPASKAPAEKKPAAKKTSTSTDGKKRSKARKETYSSYIYKVLK
QTHPDTGISQKSMSILNSFVNDIFERIATEASKLAAYNKKSTISAREIQT
AVRLILPGELAKHAVSEGTRAVTKYSSSTQA

YLR294C, 830 bp, CDS: 501-830 (SEQ ID NO 281)
ACCAACCAACTTCTTCCTTTGTCCTCAATATCAAAGAAAAAAAAAAAAAC
CCACTGCTCAGATGTTATAAGGAAGGGGTGTTAACTTATATACAGGTTCA
TCTACCAGTCACCAGTCCATACAAACTTGAACCGTCTGCGTACCAGTCCT
AATCAAAATGTTCCCTATCGCTTCCAGAAGAATACTGCTCAATGCTTCAG
TTCTGCCATTGAGACTGTGCAATAGAAATTTCACTACCACAAGAATATCC
TACAACGTCATACAAGATTTGTATTTGAGGGAACTAAAAGACACCAAACT
GGCTCCAAGTACCTTGCAAGATGCTGAAGGTAATGTTAAGCCTTGGAACC
CACCACAAAAACCAAATCTACCAGAATTGGAACTTCAAGGCCCAGAGGCT
TTAAAGGCTTACACCGAGCAAAATGTAGAAACTGCTCATGTTGCTAAAGA
GTCTGAAGAGGGTGAGTCAGAGCCAATTGAAGAGGATTGGCTAGTTTTGG
ATGATGCTGAGGAAACCAAAGAAAGTCATTGAACTTTTCATAGCATCCTC
CTTGTCAAGAAAAAACAAACAGAACCACAAGCTGAACAAGATCATTATT
TTTGGCTTTCTTCCTCTCATCTTTTTATATTCGAATCCAGTACAATAAAG
AAAAAGCAAAATACACTACGCACTCTTTGTAATCAGCCACACAAAATGCA
GAATTTATTTTTTAAACAAAAAATACAATTGTACATAGACACGTCTTTAT
CTTTCCTATTACTACTATTCTTTTATTTCAATAACTATTACTTTCTAAGT
ATGACCTACGCTTCTTTGGTAAATAAATAA

YLR294C, 109aa (SEQ ID NO 282)
MMLRKPKKVIELFIASSLSKKKQTEPQAEQDHYFWLSSSHLFIFESSTIK
KKQNTLRTLCNQPHKMQNLFFKQKIQLYIDTSLSFLLLLFFYFNNYYFLS

MTYASLVNK

YMR256C, 683 bp, CDS: 501-683 (SEQ ID NO 319)
CTTTTCAGTTATTTACCTTCCTTTCTCTCACGTGTAAATATTTGTGTGTC
ATACACACCGCTAAAAACCTTTGCATCAACTTATACCCTACATTTCTATA
GACGCTATTTGGAAACAAGATGTAACCCTTTTTTTCTTTTAGTTTTGAGA
TTTGTACTCGTAAAGAGTACGTTTATTTATTTATTCAAATTTTATTCTTC
ATACCATGTAAATATAAGCGCATATAATCACTACGATCTTAGTACAGCTA
GAATTGCTGACGCTTACAATTGCTTTATTGTTTGATTATATGCACGTATA
CATATAGTGTCAGCAAAAAAAAAAAAGGCAGTACTTGATTGGCTACGCC
GCGCATCGTCCGAGAAATCCGGCCTGGTAGGGGCAGGTTTGAAAAGGCGG
ATAGAAATAAAAGATGATATTATTTATTCATCCATGAATAGTAGAACTC
GATATAAGATTCTAAACCAACAAGTACAGAAAGCAAAACAATAATAAATA
ATGGCTAATAAAGTTATTCAACTACAGAAAATCTTCCAATCTTCCACTAA
ACCTCTATGGTGGAGACATCCAAGGTCAGCTTTATACCTGTATCCATTTT
ATGCTATTTTTGCGGTAGCCGTCGTTACACCACTTCTATACATTCCAAAT
GCTATTAGAGGTATCAAAGCCAAGAAGGCATAG

YMR256C, 60 aa (SEQ ID NO 320)
MANKVIQLQKIFQSSTKPLWWRHPRSALYLYPFYAIFAVAVVTPLLYIPN
AIRGIKAKKA

YLR327C, 761 bp, CDS: 501-761 (SEQ ID NO 287)
TTCTCATACGTATGTTTTTTTAGATTATGCACCTTCTTTGCCACAGTAAA
TGTGGCGGGGAAGATGTTGAGCTAGCGCCGTGCACAGTGGAAGAGACGGA
GGCGATTGTGGGGTTTCATCGGATTGTGCGGGAAGAAGGCCTACACCGTG
TTGAGCCACCCCCCCCTCAGGAGTAAATTTACACAAACAGTGGTGGTGCC
TATGGTGGTATACGAGATAGTGATAGAAGCTGCTGGATTGGGGTAGAAAT
TTTGTAGGCGTTTATGGATATGGTATGGATATGGTATGGCTTGAGGTAGG
TAATCCAGACACCACTGGAAATATATATAAGGAGAGAGTTCTGGCAGGTA
GATTTGTACTCCTCTCTACCACTTTCTTCTACTCCTTTTATTATGTAATG
TTTATTATAAGCACAGCAAAAACGTTAAATAAATCTAATAAGATTTCATT
ATAACATAACATTAAAGCACACAAATTTCTAACACAAACACAATTCAAAC
ATGACCAGAACTAGCAAATGGACAGTCCACGAAGCAAAGTCTAACCCAAA
GTATTTCACCCATAACGGCAACTTTGGGGAGTCTCCCAACCACGTCAAGA
GAGGAGGCTATGGGAAAGGCAATTGGGGCAAGCCTGGCGATGAGATTAAT
GACTTAATCGATTCTGGCGAAATTAAGACAGTCTTCAACAAGACCAGAAG
GGGCTCTAACTCCCAAAACAATGAAAGAAGGCTTTCTGATTTGCAACAAT
ACCACATCTAA

YLR327C, 86 aa (SEQ ID NO 288)
MTRTSKWTVHEAKSNPKYFTHNGNFGESPNHVKRGGYGKGNWGKPGDEIN
DLIDSGEIKTVFNKTRRGSNSQNNERRLSDLQQYHI

YHR161C, 2414 bp, CDS: 501-2414 (SEQ ID NO 211)
GTCATGCGCGCAATAGGAAAGCGCACGAAACAAATGAGTAATTCGTAGGA
AACAATGCAGCCCCCAGGGTCAGCAACTGACGTGACTCAGCCTGGCTTTT
GTAGAAAAAGATGACGCCCTGGCAGAGAGGTGGGGGAATTGAGGGGTCCT
CGCTACCCACCTTAAGTATGGAAGAATATGATGAAGAATATGATGATAAC
TCTTGGAAGCGAGCGGCGGGTTCCATCACTTTTTACGGATTGGTAACACA
GGGGCCTCAGTTCGATACTTGGTATTCAGGCTTCCAGCGTTGGTGAGTTT
AGTTAGCGGTATGGTATGCACATGGTGTTGATGCTTGGTGGTAATCATTC
GTTAGGTGAATTGAGCAGTAGCGATATTAGATATATTTAGTATTTTATAG
CGTCTTTTTGGTGGGGAGGAAGGACAAAACCTGTCTCGTAAATATAAAG
GGACTGTTCGATATCGCAGATACTAGAGTATAAATTTCGATTGAGGCGAG
ATGACAACATATTTCAAGTTGGTAAAAGGTGCTACCAAGATCAAGTCAGC

```
CCCGCCCAAACAGAAGTATCTGGATCCGATACTGTTGGGGACCAGCAATG
AAGAGGATTTCTATGAGATCGTGAAGGGTTTGGATTCCCGAATTAATGAC
ACGGCGTGGACTATTGTGTATAAATCGCTGTTGGTGGTTCATTTGATGAT
AAGGGAGGGTTCCAAAGATGTTGCATTGCGGTACTACTCTAGGAACCTGG
AGTTTTTTGACATTGAAAACATACGTGGCTCCAATGGCAGTGCGTCTGGA
GACATGAGGGCACTTGATAGATACGATAATTATCTGAAGGTGAGATGCAG
GGAGTTTGGTAAAATCAAAAAGGACTATGTGAGAGACGGCTATCGAACAC
TGAAGCTGAACAGTGGCAATTACGGAAGCTCCAGAAACAAGCAACACTCT
ATCAATATAGCACTAGATCATGTGGAGTCCCTAGAGGTACAAATACAAGC
CCTGATTAAAAACAAGTATACACAATATGATTTGAGTAACGAATTGATCA
TATTTGGTTTCAAGCTGCTTATTCAAGACCTGCTAGCGCTATATAATGCT
CTCAACGAAGGTATCATAACTCTGCTGGAGTCTTTTTTCGAACTATCTCA
TCATAATGCAGAGAGAACTCTAGACCTGTACAAGACGTTTGTTGATTTGA
CCGAGCACGTTGTCAGGTACTTGAAGAGCGGGAAGACTGCGGGCTTGAAA
ATACCCGTCATCAAGCATATCACTACCAAACTGGTCAGATCGCTAGAAGA
ACATCTGATAGAGGATGATAAGACGCACAACACTTTTGTGCCCGTTGACA
GTTCTCAAGGAAGTGCTGGGCCGTAGTAGCCAAATCTACTGCACAGGAA
AGGTTGGAGCAAATCCGGGAACAAAAAAGGATACTAGAGGCACAATTGAA
AAACGAACAAGTAGCGATTTCCCCTGCTCTAACTACTGTCACGGCGGCTC
AATCTTACAACCCGTTTGGAACAGACTCTTCTATGCATACTAACATTCCA
ATGGCTGTGGCTAATCAAACGCAACAGATCGCAAATAACCCATTTGTATC
TCAAACTCAGCCACAGGTGATGAATACACCAACCGCTCATACAGAGCCCG
CAAATTTAAACGTTCCTGAATATGCAGCGGTCCAACACACAGTGAACTTC
AACCCTGTACAAGATGCTGGCGTAAGTGCCCAACAAACGGGGTACTATTC
GATTAACAACCATTTAACACCCACATTTACAGGTGCAGGGTTTGGAGGAT
ACTCCGTTTCACAGGATACAACTGCCGCTTCTAATCAACAAGTCTCTCAT
TCACAAACTGGTTCTAACAACCCGTTCGCATTGCACAACGCCGCGACGAT
CGCAACAGGGAATCCTGCACACGAAAATGTCTTAAATAACCCATTTCAC
GACCAAACTTTGATGAACAAAATACCAATATGCCGCTACAACAACAGATA
ATAAGTAACCCTTTTCAAAACCAAACGTACAATCAACAACAATTTCAACA
ACAAAAAATGCCTTTGAGCTCGATCAATAGCGTTATGACAACCCCTACTA
GCATGCAGGGATCGATGAATATTCCTCAGCGTTTTGATAAAATGGAATTT
CAGGCTCACTACACTCAGAATCATCTCCAACAACAGCAACAACAGCAACA
GCAACAACAGCAACAGCAACAACAGCAACCACAACAGGGTTATTATGTGC
CTGCAACTGCAGGAGCCAACCCTGTTACAAATATAACTGGGACAGTTCAA
CCTCAAAATTTCCCTTTCTATCCACAACAGCAACCACAACCGGAACAGTC
TCAAACACAGCAACCAGTTTTAGGAAACCAATATGCTAACAACCTCAATT
TAATTGATATGTAA

YHR161C, 637 aa (SEQ ID NO 212)
MTTYFKLVKGATKIKSAPPKQKYLDPILLGTSNEEDFYEIVKGLDSRIND
TAWTIVYKSLLVVHLMIREGSKDVALRYYSRNLEFFDIENIRGSNGSASG
DMRALDRYDNYLKVRCREFGKIKKDYVRDGYRTLKLNSGNYGSSRNKQHS
INIALDHVESLEVQIQALIKNKYTQYDLSNELIIFGFKLLIQDLLALYNA
LNEGIITLLESFFELSHHNAERTLDLYKTFVDLTEHVVRYLKSGKTAGLK
IPVIKHITTKLVRSLEEHLIEDDKTHNTFVPVDSSQGSAGAVVAKSTAQE
RLEQIREQKRILEAQLKNEQVAISPALTTVTAAQSYNPFGTDSSMHTNIP
MAVANQTQQIANNPFVSQTQPQVMNTPTAHTEPANLNVPEYAAVQHTVNF
NPVQDAGVSAQQTGYYSINNHLTPTFTAGFGGYSVSQDTTAASNQQVSH
SQTGSNNPFALHNAATIATGNPAHENVLNNPFSRPNFDEQNTNMPLQQQI
ISNPFQNQTYNQQQFQQQKMPLSSINSVMTTPTSMQGSMNIPQRFDKMEF
QAHYTQNHLQQQQQQQQQQQQQQQQPQQGYYVPATAGANPVTNITGTVQ
PQNFPFYPQQQPQPEQSQTQQPVLGNQYANNLNLIDM

YLR206W, 2342 bp, CDS: 501-2342 (SEQ ID NO 277)
TACACCCTGACTTTCCCCATCATACGACGATGCTCTAGTAAACTTGCACC
```

```
CGCACCTGTTAGATAAACAAGTGCGCCCAAGATCACAATACCGAAGGGGC
GATATCACCACTCAGTATTCTACAGTCGAGCATAGCGTAGTCTGGCAGTA
TCCCGCACGATCCATTGTATTGTTTGTCCAAACCGCATTTTATGTGTAAC
GATTAATCGTATATACATGGCCTACAAGAAATTACCCTGCGGCGAAGGGT
GAAAAAAAAGTAGTGGAAACTAAAGAAAGAAGAGTTTAGTTACGGACCC
TTTCAAGGATTGACACACTCCCAATATTTTGCTACATTATTGACCTTTGT
TGAAGGAGGCGTTCGTTTATTTAATTATTTTGTTCTGTTTTGCCTACAAC
TGCGAATACGCTCACATTCTAGTTTGACCTTCACAAATTCTTATCATCTT
CTTTTGTTTATTTTGACACACCCCTATTAAGTGTATTTGTTTTGTAAGTA
ATGTCTAAGCAGTTTGTTCGTTCTGCAAAGAACATGATGAAGGGCTACTC
ATCCACACAAGTGCTTGTAGAGATGCCACGGCGAACGACTCGAGGACTC
CATCGATAGACACTCTCGACGATTTGGCACAGAGATCTTACGATTCGGTG
GACTTCTTCGAGATTATGGATATGTTAGACAAGAGGCTGAACGATAAGGG
CAAATACTGGAGACACGTTGCCAAATCGCTGACCGTTTTGGACTATCTTG
TTCGTTTCGGGAGTGAGAACTGTGTGCTATGGTGCAGAGAGAATTTTTAC
GTAATTAAGACATTAAGGGAATTCAGACACGAAAATGAGTCCGGATTTGA
CGAGGGACAAATTATCAGAGTAAAGGCTAAAGAACTCGTCTCTTTGTTGA
ATGATGAAGAAGGCTACGCGAAGAGAGGTCTATGAATACAAGAAACAGA
AGGGCGAACAGAGCTGCTAGGCCAAGGCCAAGAAGACAAAGAACAAGGAG
CAACCCACACGATTCTTCTCCCTCTTACCAGGACGATTTGGAAAAGGCCC
TAGAGGAGAGCAGAATTACTGCTCAAGAAGATGAACAACGTAGAAGAGAA
CTGGCCCAGTACGACGATGAAGATCCTGACTTCCAAGCTGCCTTACAACT
AAGTAAAGAAGAAGAGGAGTTGAAGCAATTGCAGGAACTACAGAGATTAC
AGAAGCAACAACAGTCTCTGTCTCAATTTCAAGCTCCTTTACAACAACAA
CAACCACAACAACAACCAGCGTACTACGACATTTTCGGTAATCCAATCTC
CCAAGATGAATACTTACAGTATCAGTACCAACAGGACCAGGAACAAGCAA
TGGCTCAGCAAAGATGGCTGGACCAGCAGCAAGAACAACAGCAGCTTGCT
GAACAACAATATTTTCAGCAGCAACAACAAGCTGCGGCCGCCGCTTCTGC
CTTGCAACAGCAACAAACAGCCGCTAATATGCAACAACAACAACAACAGC
CCGCTGATTTTCAACAACCTTTGCCTACAGGTTCTAATAATCCGTTTTCC
ATGGATAATCTTGAAAGACAAAAGCAGGAGCAACAGCATGCTCAATTGCA
AAGACAACAAGAAGAAGCTAGACAACAACAAGAACAATTGAAGCTACAAC
AATTGCAAAGACAACAACAAGAGGAAGCTCAATTACACCAGAAGAGGCAA
GAAGAAGCCCAATTACAACAGCAGCAAGCCCAATTGCTACAACAGCAAGC
CCAGTTCCAGCAACAACAACCCTTGAAGCAAACAAGGACTGGGAACCAGT
CTATATCGGATAAATACAGCGACTTGAATACCTTGTTAGCAACTGGTACA
GGGATAGATACTTTTGGTAACACTGGAGAGGCACGTATTCCTGCACAACA
TACAAAGACAGGCACATTTATAAATTCTCAGGGTACAGGCTACAAACAGG
TTACTAATGAACCCAAGAACAACCCTTTCTTAAGCAACCAATACACTGGT
TTACCAAGCACAAATATCGTGCCCACGCAAACAGGGTACGGGTTTGGTAA
CCAACCTCAAAGTCCTCCTACTAATTCTCCTCAGCAAAATCCTACTGGTA
TAAGCTACTCTCAGCCACAACAGCAACAACAGCCACAGCAACAACCGCAA
TACATGCAAAATTTCCAACAACAGCAACCTCAATACGCCCAAAACTTCCA
ACAACAACCACAATACACTCAAAATTATCAACAACAACCACAATACATTC
AACCTCATCAACAACAACAGCAGCAGCAGCAGCAACAGCAGCAACAG
GGATATACTCCTGACCAAGGTGTAAGCTTAATTGATCTTTGA
```

YLR206W, 613 aa (SEQ ID NO 278)
MSKQFVRSAKNMMKGYSSTQVLVRDATANDSRTPSIDTLDDLAQRSYDSV
DFFEIMDMLDKRLNDKGKYWRHVAKSLTVLDYLVRFGSENCVLWCRENFY
VIKTLREFRHENESGFDEGQIIRVKAKELVSLLNDEERLREERSMNTRNR
RANRAARPRPRRQRTRSNPHDSSPSYQDDLEKALEESRITAQEDEQRRRE
LAQYDDEDPDFQAALQLSKEEEELKQLQELQRLQKQQQSLSQFQAPLQQQ
QPQQQPAYYDIFGNPISQDEYLQYQYQQDQEQAMAQQRWLDQQQEQQQLA
EQQYFQQQQQAAAASALQQQQTAANMQQQQQQPADFQQPLPTGSNNPFS
MDNLERQKQEQQHAQLQRQQEEARQQQEQLKLQQLQRQQQEEAQLHQKRQ

EEAQLQQQQAQLLQQQAQFQQQQPLKQTRTGNQSISDKYSDLNTLLATGT
GIDTFGNTGEARIPAQHTKTGTFINSQGTGYKQVTNEPKNNPFLSNQYTG
LPSTNIVPTQTGYGFGNQPQSPPTNSPQQNPTGISYSQPQQQQQPQQQPQ
YMQNFQQQPQYAQNFQQQPQYTQNYQQQPQYIQPHQQQQQQQQQQQQQQ
GYTPDQGVSLIDL

YDR342C, 2213 bp, CDS: 501-2213 (SEQ ID NO 119)
CACTTCTCAGAAATGCATGCAGTGGCAGCACGCTAATTCGAAAAAATTCT
CCAGAAAGGCAACGCAAAATTTTTTTTCCAGGGAATAAACTTTTTATGAC
CCACTACTTCTCGTAGGAACAATTTCGGGCCCCTGCGTGTTCTTCTGAGG
TTCATCTTTTACATTTGCTTCTGCTGGATAATTTTCAGAGGCAACAAGGA
AAAATTAGATGGCAAAAGTCGTCTTTCAAGGAAAAATCCCCACCATCTT
TCGAGATCCCCTGTAACTTATTGGCAACTGAAAGAATGAAAAGGAGGAAA
ATACAAAATATACTAGAACTGAAAAAAAAAAGTATAAATAGAGACGATA
TATGCCAATACTTCACAATGTTCGAATCTATTCTTCATTTGCAGCTATTG
TAAAATAATAAACATCAAGAACAAACAAGCTCAACTTGTCTTTTCTAAG
AACAAAGAATAAACACAAAAACAAAAGTTTTTTTAATTTTAATCAAAAA
ATGTCACAAGACGCTGCTATTGCAGAGCAAACTCCTGTGGAGCATCTCTC
TGCTGTTGACTCAGCCTCCCACTCGGTTTTATCTACACCATCAAACAAGG
CTGAAAGAGATGAAATAAAAGCTTATGGTGAAGGTGAAGAGCACGAACCT
GTCGTTGAAATTCCAAAGAGACCAGCTTCTGCCTATGTCACTGTCTCTAT
TATGTGTATCATGATCGCCTTTGGTGGTTTCGTTTTCGGTTGGGATACTG
GTACCATTTCTGGTTTCATCAATCAAACCGATTTCATCAGAAGATTTGGT
ATGAAGCATAAAGATGGTACTAATTATTTGTCTAAGGTTAGAACTGGTTT
GATTGTCTCCATTTTCAACATTGGTTGTGCCATTGGTGGTATTATTCTTT
CCAAATTGGGTGATATGTACGGTCGTAAGGTGGGTTTGATTGTCGTTGTT
GTCATCTACATCATCGGTATTATTATTCAAATTGCATCTATCAACAAATG
GTACCAATATTTCATCGGTAGAATTATTTCCGGTTTGGGTGTTGGTGGTA
TTGCCGTTTTATCTCCTATGTTGATTTCTGAAGTATCCCCAAAGCATTTA
AGGGGTACTTTAGTCTCTTGCTACCAATTGATGATTACTGCCGGTATTTT
CTTGGGTTACTGTACCAACTTCGGTACTAAGAACTACTCCAACTCTGTGC
AATGGAGAGTTCCATTAGGTTTGTGTTTTGCCTGGGCTTTGTTTATGATT
GGTGGTATGACATTTGTTCCAGAGTCTCCACGTTATTTGGCTGAAGTCGG
TAAGATCGAAGAAGCCAAACGTTCTATTGCCGTTTCTAACAAGGTTGCTG
TTGATGATCCATCTGTTTTGGCTGAAGTCGAAGCTGTCTTGGCTGGTGTA
GAGGCAGAGAAATTAGCTGGTAATGCATCCTGGGGTGAATTGTTTAGTAG
CAAGACAAAGGTCCTTCAGCGTTTGATCATGGGTGCTATGATTCAATCTC
TACAACAATTGACAGGTGATAACTATTTCTTCTACTATGGTACTACTATT
TTCAAGGCTGTTGGTTTGAGTGACTCTTTCGAAACCTCTATTGTCTTGGG
TATTGTTAACTTTGCTTCCACCTTTGTTGGTATTTACGTTGTTGAGAGAT
ATGGTCGTCGTACTTGTTTGCTATGGGGTGCTGCATCCATGACTGCTTGT
ATGGTTGTCTATGCTTCCGTGGGTGTCACCAGATTATGGCCAAATGGTCA
AGACCAACCATCTTCCAAGGGTGCTGGTAACTGTATGATTGTCTTTGCCT
GTTTCTATATTTTCTGTTTTGCTACTACATGGGCTCCAATTCCTTATGTC
GTTGTTTCTGAAACTTTCCCATTGAGAGTCAAGTCTAAGGCTATGTCTAT
TGCTACAGCTGCTAATTGGTTGTGGGGTTTCTTGATTGGTTTCTTCACTC
CATTTATTACTGGTGCTATTAACTTCTACTACGGTTACGTTTTCATGGGC
TGTTTGGTCTTCATGTTCTTCTATGTTTTGTTAGTTGTTCCAGAAACTAA
GGGTTTGACTTTGGAAGAAGTCAACACCATGTGGGAAGAAGGTGTTCTAC
CATGGAAGTCTGCCTCATGGGTTCCACCATCCAGAAGAGGTGCCAACTAC
GACGCTGAAGAAATGACTCACGATGACAAGCCATTGTACAAGAGAATGTT
CAGCACCAAATAA

YDR342C, 570 aa (SEQ ID NO 120)
MSQDAAIAEQTPVEHLSAVDSASHSVLSTPSNKAERDEIKAYGEGEEHEP
VVEIPKRPASAYVTVSIMCIMIAFGGFVFGWDTGTISGFINQTDFIRRFG

MKHKDGTNYLSKVRTGLIVSIFNIGCAIGGIILSKLGDMYGRKVGLIVVV
VIYIIGIIIQIASINKWYQYFIGRIISGLGVGGIAVLSPMLISEVSPKHL
RGTLVSCYQLMITAGIFLGYCTNFGTKNYSNSVQWRVPLGLCFAWALFMI
GGMTFVPESPRYLAEVGKIEEAKRSIAVSNKVAVDDPSVLAEVEAVLAGV
EAEKLAGNASWGELFSSKTKVLQRLIMGAMIQSLQQLTGDNYFFYYGTTI
FKAVGLSDSFETSIVLGIVNFASTFVGIYVVERYGRRTCLLWGAASMTAC
MVVYASVGVTRLWPNGQDQPSSKGAGNCMIVFACFYIFCFATTWAPIPYV
VVSETFPLRVKSKAMSIATAANWLWGFLIGFFTPFITGAINFYYGYVFMG
CLVFMFFYVLLVVPETKGLTLEEVNTMWEEGVLPWKSASWVPPSRRGANY
DAEEMTHDDKPLYKRMFSTK

YDR343C, 2213 bp, CDS: 501-2213 (SEQ ID NO 121)
AAAAAAATGTTTTTTAGGCAACGGAGATTCGTTTTATCCACGTTTACCCC
ACAAAAAGTGCAGGTACATTGTGGGCCCCGGCATCGAAAACCAGTTTTT
TTCCTTTAAACGCTGGAAAAAAGGAGAAATTATTGGAACTTTGCAGAGA
ATAGTCCGTAGGCAAATTGAAAATGTTCCTTAAAAAATTTCGTTTCTTAC
TCATTGAGATTATTCAGATGCCCTCCGTGCCTTCATTGAAAAAAATCCAA
GAGATGTCTCGGATCTGTATGCAGATTTTGGCTTGCAGACAATGGAGAGC
AAATGGGTATACAATATAGAAAGCACAGAAACATATAAAAAGAGCTCGAG
AAAAGACATATGGTTTGTAACTATCTTCTTCTTTTTTCCAATTTTTCTGT
TTTAATAATAAAAAAACAAGAACAAACAAGCTCAACTTGTCTTTTCTAAG
AACAAAGAATAAACACAAAAACAAAAAGTTTTTTTAATTTTAATCAAAAA
ATGTCACAAGACGCTGCTATTGCAGAGCAAACTCCTGTGGAGCATCTCTC
TGCTGTTGACTCAGCCTCCCACTCGGTTTTATCTACACCATCAAACAAGG
CTGAAAGAGATGAAATAAAAGCTTATGGTGAAGGTGAAGAGCACGAACCT
GTCGTTGAAATTCCAAGAGACCAGCTTCTGCCTATGTCACTGTCTCTAT
TATGTGTATCATGATCGCCTTTGGTGGTTTCGTTTTCGGTTGGGATACTG
GTACCATTTCTGGTTTCATCAATCAAACCGATTTCATCAGAAGATTTGGT
ATGAAGCATAAAGATGGTACTAATTATTTGTCTAAGGTTAGAACTGGTTT
GATTGTCTCCATTTTCAACATTGGTTGTGCCATTGGTGGTATTATTCTTT
CCAAATTGGGTGATATGTACGGTCGTAAGGTGGGTTTGATTGTCGTTGTT
GTCATCTACATCATCGGTATTATTATTCAAATTGCATCTATCAACAAATG
GTACCAATATTTCATCGGTAGAATTATTTCCGGTTTGGGTGTTGGTGGTA
TTGCCGTTTTATCTCCTATGTTGATTTCTGAAGTATCCCCAAAGCATTTA
AGGGGTACTTTAGTCTCTTGCTACCAATTGATGATTACTGCCGGTATTTT
CTTGGGTTACTGTACCAACTTCGGTACTAAGAACTACTCCAACTCTGTGC
AATGGAGAGTTCCATTAGGTTTGTGTTTTGCCTGGGCTTTGTTTATGATT
GGTGGTATGACATTTGTTCCAGAGTCTCCACGTTATTTGGCTGAAGTCGG
TAAGATCGAAGAAGCCAAACGTTCTATTGCCGTTTCTAACAAGGTTGCTG
TTGATGATCCATCTGTTTTGGCTGAAGTCGAAGCTGTCTTGGCTGGTGTA
GAGGCAGAGAAATTAGCTGGTAATGCATCCTGGGGTGAATTGTTTAGTAG
CAAGACAAAGGTCCTTCAGCGTTTGATCATGGGTGCTATGATTCAATCTC
TACAACAATTGACAGGTGATAACTATTTCTTCTACTATGGTACTACTATT
TTCAAGGCTGTTGGTTTGAGTGACTCTTTCGAAACCTCTATTGTCTTGGG
TATTGTTAACTTTGCTTCCACCTTTGTTGGTATTTACGTTGTTGAGAGAT
ATGGTCGTCGTACTTGTTTGCTATGGGGTGCTGCATCCATGACTGCTTGT
ATGGTTGTCTATGCTTCCGTGGGTGTCACCAGATTATGGCCAAATGGTCA
AGACCAACCATCTTCCAAGGGTGCTGGTAACTGTATGATTGTCTTTGCCT
GTTTCTATATTTTCTGTTTTGCTACTACATGGGCTCCAATTCCTTATGTC
GTTGTTTCTGAAACTTTCCCATTGAGAGTCAAGTCTAAGGCTATGTCTAT
TGCTACAGCTGCTAATTGGTTGTGGGGTTTCTTGATTGGTTTCTTCACTC
CATTTATTACTGGTGCTATTAACTTCTACTACGGTTACGTTTTCATGGGC
TGTTTGGTCTTCATGTTCTTCTATGTTTTGTTAGTTGTTCCAGAAACTAA
GGGTTTGACTTTGGAAGAAGTCAACACCATGTGGGAAGAAGGTGTTCTAC
CATGGAAGTCTGCCTCATGGGTTCCACCATCTAGAAGAGGTGCCAACTAC
GACGCTGAAGAAATGGCTCACGATGATAAGCCATTGTACAAGAGAATGTT

CAGCACCAAATAA

YDR343C, 570 aa (SEQ ID NO 122)
MSQDAAIAEQTPVEHLSAVDSASHSVLSTPSNKAERDEIKAYGEGEEHEP
VVEIPKRPASAYVTVSIMCIMIAFGGFVFGWDTGTISGFINQTDFIRRFG
MKHKDGTNYLSKVRTGLIVSIFNIGCAIGGIILSKLGDMYGRKVGLIVVV
VIYIIGIIQIASINKWYQYFIGRIISGLGVGGIAVLSPMLISEVSPKHL
RGTLVSCYQLMITAGIFLGYCTNFGTKNYSNSVQWRVPLGLCFAWALFMI
GGMTFVPESPRYLAEVGKIEEAKRSIAVSNKVAVDDPSVLAEVEAVLAGV
EAEKLAGNASWGELFSSKTKVLQRLIMGAMIQSLQQLTGDNYFFYYGTTI
FKAVGLSDSFETSIVLGIVNFASTFVGIYVVERYGRRTCLLWGAASMTAC
MVVYASVGVTRLWPNGQDQPSSKGAGNCMIVFACFYIFCFATTWAPIPYV
VVSETFPLRVKSKAMSIATAANWLWGFLIGFFTPFITGAINFYYGYVFMG
CLVFMFFYVLLVVPETKGLTLEEVNTMWEEGVLPWKSASWVPPSRRGANY
DAEEMAHDDKPLYKRMFSTK

YGR192C, 1499 bp, CDS: 501-1499 (SEQ ID NO 183)
ACAGTTTATTCCTGGCATCCACTAAATATAATGGAGCCCGCTTTTTAAGC
TGGCATCCAGAAAAAAAAGAATCCCAGCACCAAAATATTGTTTTCTTCA
CCAACCATCAGTTCATAGGTCCATTCTCTTAGCGCAACTACAGAGAACAG
GGGCACAAACAGGCAAAAAACGGGCACAACCTCAATGGAGTGATGCAACC
TGCCTGGAGTAAATGATGACACAAGGCAATTGACCCACGCATGTATCTAT
CTCATTTTCTTACACCTTCTATTACCTTCTGCTCTCTCTGATTTGGAAAA
AGCTGAAAAAAAGGTTGAAACCAGTTCCCTGAAATTATTCCCCTACTTG
ACTAATAAGTATATAAAGACGGTAGGTATTGATTGTAATTCTGTAAATCT
ATTTCTTAAACTTCTTAAATTCTACTTTTATAGTTAGTCTTTTTTTTAGT
TTTAAAACACCAAGAACTTAGTTTCGAATAAACACACATAAACAAACAAA
ATGGTTAGAGTTGCTATTAACGGTTTCGGTAGAATCGGTAGATTGGTCAT
GAGAATTGCTTTGTCTAGACCAAACGTCGAAGTTGTTGCTTTGAACGACC
CATTCATCACCAACGACTACGCTGCTTACATGTTCAAGTACGACTCCACT
CACGGTAGATACGCTGGTGAAGTTTCCCACGATGACAAGCACATCATTGT
CGATGGTAAGAAGATTGCTACTTACCAAGAAAGAGACCCAGCTAACTTGC
CATGGGGTTCTTCCAACGTTGACATCGCCATTGACTCCACTGGTGTTTTC
AAGGAATTAGACACTGCTCAAAAGCACATTGACGCTGGTGCCAAGAAGGT
TGTTATCACTGCTCCATCTTCCACCGCCCCAATGTTCGTCATGGGTGTTA
ACGAAGAAAAATACACTTCTGACTTGAAGATTGTTTCCAACGCTTCTTGT
ACCACCAACTGTTTGGCTCCATTGGCCAAGGTTATCAACGATGCTTTCGG
TATTGAAGAAGGTTTGATGACCACTGTCCACTCTTTGACTGCTACTCAAA
AGACTGTTGACGGTCCATCCCACAAGGACTGGAGAGGTGGTAGAACCGCT
TCCGGTAACATCATCCCATCCTCCACCGGTGCTGCTAAGGCTGTCGGTAA
GGTCTTGCCAGAATTGCAAGGTAAGTTGACCGGTATGGCTTTCAGAGTCC
CAACCGTCGATGTCTCCGTTGTTGACTTGACTGTCAAGTTGAACAAGGAA
ACCACCTACGATGAAATCAAGAAGGTTGTTAAGGCTGCCGCTGAAGGTAA
GTTGAAGGGTGTTTTGGGTTACACCGAAGACGCTGTTGTCTCCTCTGACT
TCTTGGGTGACTCTCACTCTTCCATCTTCGATGCTTCCGCTGGTATCCAA
TTGTCTCCAAAGTTCGTCAAGTTGGTCTCCTGGTACGACAACGAATACGG
TTACTCTACCAGAGTTGTCGACTTGGTTGAACACGTTGCCAAGGCTTAA

YGR192C, 332 aa (SEQ ID NO 184)
MVRVAINGFGRIGRLVMRIALSRPNVEVVALNDPFITNDYAAYMFKYDST
HGRYAGEVSHDDKHIIVDGKKIATYQERDPANLPWGSSNVDIAIDSTGVF
KELDTAQKHIDAGAKKVVITAPSSTAPMFVMGVNEEKYTSDLKIVSNASC
TTNCLAPLAKVINDAFGIEEGLMTTVHSLTATQKTVDGPSHKDWRGGRTA
SGNIIPSSTGAAKAVGKVLPELQGKLTGMAFRVPTVDVSVVDLTVKLNKE
TTYDEIKKVVKAAAEGKLKGVLGYTEDAVVSSDFLGDSHSSIFDASAGIQ
LSPKFVKLVSWYDNEYGYSTRVVDLVEHVAKA

YOR374W, 2060 bp, CDS: 501-2060 (SEQ ID NO 373)
CGACCCTCTGGTTAGATGACACTCCTGCCCCAACTGCCACGAATCTGTAA
CCCCATAACTATACCCGTACGCAGTACTAAAAATGTATGTAATTAGTAAA
TGTATGTAACAATTTCACCGTTTTGTGTAACAATTCATTCATTCATTCTT
TTGATCCTTTAGTACCGTCCGCACATGATGTCATTTCCCCCTCATTTTTG
TTTGCTGGTATGATTCCCCGCCCGGGCGACGGTACGGCTGTTATCCAGCG
ATGCGGGACTTCCGTCCACAGGTATCTTTTCTCCAACTCCAACAGAGAT
GGAAAATGAGGGCGGGTGTAGGTAAGCAGAATGAGGAGAAATTTGTAAT
GAAAATGGAAGTTCGGCGGTTATATAAATGGGGGGGGTTTGTCGGTGACA
ATTGACTTCACTCTCCTTTCCTCAAAAATTCTTGGGTGTTAGGATTAGAA
GTATCTGGAAAACCAACCAAGAAAACTACAATAACAAAAATAAATAAAGC
ATGTTCAGTAGATCTACGCTCTGCTTAAAGACGTCTGCATCCTCCATTGG
GAGACTTCAATTGAGATATTTCTCACACCTTCCTATGACAGTGCCTATCA
AGCTGCCCAATGGGTTGGAATATGAGCAACCAACGGGGTTGTTCATCAAC
AACAAGTTTGTTCCTTCTAAACAGAACAAGACCTTCGAAGTCATTAACCC
TTCCACGGAAGAAGAAATATGTCATATTTATGAAGGTAGAGAGGACGATG
TGGAAGAGGCCGTGCAGGCCGCCGACCGTGCCTTCTCTAATGGGTCTTGG
AACGGTATCGACCCTATTGACAGGGGTAAGGCTTTGTACAGGTTAGCCGA
ATTAATTGAACAGGACAAGGATGTCATTGCTTCCATCGAGACTTTGGATA
ACGGTAAAGCTATCTCTTCCTCGAGAGGAGATGTTGATTTAGTCATCAAC
TATTTGAAATCTTCTGCTGGCTTTGCTGATAAAATTGATGGTAGAATGAT
TGATACTGGTAGAACCCATTTTTCTTACACTAAGAGACAGCCTTTGGGTG
TTTGTGGGCAGATTATTCCTTGGAATTTCCCACTGTTGATGTGGGCCTGG
AAGATTGCCCCTGCTTTGGTCACCGGTAACACCGTCGTGTTGAAGACTGC
CGAATCCACCCCATTGTCCGCTTTGTATGTGTCTAAATACATCCCACAGG
CGGGTATTCCACCTGGTGTGATCAACATTGTATCCGGGTTTGGTAAGATT
GTGGGTGAGGCCATTACAAACCATCCAAAAATCAAAAAGGTTGCCTTCAC
AGGGTCCACGGCTACGGGTAGACACATTTACCAGTCCGCAGCCGCAGGCT
TGAAAAAAGTGACTTTGGAGCTGGGTGGTAAATCACCAAACATTGTCTTC
GCGGACGCCGAGTTGAAAAAAGCCGTGCAAAACATTATCCTTGGTATCTA
CTACAATTCTGGTGAGGTCTGTTGTGCGGGTTCAAGGGTGTATGTTGAAG
AATCTATTTACGACAAATTCATTGAAGAGTTCAAAGCCGCTTCTGAATCC
ATCAAGGTGGGCGACCCATTCGATGAATCTACTTTCCAAGGTGCACAAAC
CTCTCAAATGCAACTAAACAAAATCTTGAAATACGTTGACATTGGTAAGA
ATGAAGGTGCTACTTTGATTACCGGTGGTGAAAGATTAGGTAGCAAGGGT
TACTTCATTAAGCCAACTGTCTTTGGTGACGTTAAGGAAGACATGAGAAT
TGTCAAAGAGGAAATCTTTGGCCCTGTTGTCACTGTAACCAAATTCAAAT
CTGCCGACGAAGTCATTAACATGGCGAACGATTCTGAATACGGGTTGGCT
GCTGGTATTCACACCTCTAATATTAATACCGCCTTAAAAGTGGCTGATAG
AGTTAATGCGGGTACGGTCTGGATAAACACTTATAACGATTTCCACCACG
CAGTTCCTTTCGGTGGGTTCAATGCATCTGGTTTGGGCAGGGAAATGTCT
GTTGATGCTTTACAAAACTACTTGCAAGTTAAAGCGGTCCGTGCCAAATT
GGACGAGTAA

YOR374W, 519 aa (SEQ ID NO 374)
MFSRSTLCLKTSASSIGRLQLRYFSHLPMTVPIKLPNGLEYEQPTGLFIN
NKFVPSKQNKTFEVINPSTEEEICHIYEGREDDVEEAVQAADRAFSNGSW
NGIDPIDRGKALYRLAELIEQDKDVIASIETLDNGKAISSSRGDVDLVIN
YLKSSAGFADKIDGRMIDTGRTHFSYTKRQPLGVCGQIIPWNFPLLMWAW
KIAPALVTGNTVVLKTAESTPLSALYVSKYIPQAGIPPGVINIVSGFGKI
VGEAITNHPKIKKVAFTGSTATGRHIYQSAAAGLKKVTLELGGKSPNIVF
ADAELKKAVQNIILGIYYNSGEVCCAGSRVYVEESIYDKFIEEFKAASES
IKVGDPFDESTFQGAQTSQMQLNKILKYVDIGKNEGATLITGGERLGSKG
YFIKPTVFGDVKEDMRIVKEEIFGPVVTVTKFKSADEVINMANDSEYGLA
AGIHTSNINTALKVADRVNAGTVWINTYNDFHHAVPFGGFNASGLGREMS
VDALQNYLQVKAVRAKLDE

YER177W, 1304 bp, CDS: 501-1304 (SEQ ID NO 151)
AGATAGATAGATATAGATAGATAATGGACGTAGTTATAGAACAGAAAATC
GGTAGATCGAAAACACAGGGGAAAAAGGGGGGGGGGGGGGGAGACAGCG
CAGCCACGTGACGGGCTTCCTCTTTGGAAAGTGGAGCGAAGTTTTGCGGA
AGCTACTTTATTCCGGCCTGGAGTCAAAAGAGGAAGCTCGGTGGCAAATA
GCTTCCTCTTTGTGGCCGGGGCGCGGGGGGACGAGGCAAAAAGCAAAGAA
AAGCAAAAAAAATAAAAAAAAAAAACAAAAAAACAGGGGTATGAGAAAAAG
ACACGCTTTTCCACGCGCAGCAAAAAGGAAAAAGGAAAAGGAAACTCTTT
ATTATTGGACCTTAAACCTGAAAACGAGACGAACCGTAACATAAAACCGT
GTAGTTTCTGCAAAAATAACTTAGTTTTTCCTACTTTTCAAAATTGAGAG
CGCAAGCAAGTGAGAAGAAAAAGCAAGTTAAAGATAAACTAAAGATAAAA
ATGTCAACCAGTCGTGAAGATTCTGTGTACCTAGCCAAGTTGGCTGAACA
GGCCGAACGTTATGAAGAAATGGTCGAAAACATGAAGACTGTTGCCTCCT
CTGGCCAAGAGTTGTCGGTCGAAGAGCGTAATTTGTTGTCTGTTGCTTAT
AAGAACGTTATTGGTGCTCGTCGTGCCTCTTGGAGAATTGTTTCTTCTAT
TGAGCAAAAGGAGGAGTCCAAGGAGAAGTCCGAACACCAGGTCGAGTTGA
TTTGTTCGTACCGTTCGAAGATTGAGACCGAACTAACTAAGATCTCCGAC
GATATTTTGTCCGTGCTAGACTCCCACTTAATTCCATCAGCCACCACTGG
CGAGTCCAAGGTTTTCTACTATAAGATGAAGGGTGACTACCACCGTTATT
TGGCTGAATTTTCTAGTGGCGATGCTAGAGAAAAGGCCACAAACGCCTCT
TTAGAAGCATACAAGACCGCTTCTGAAATTGCCACCACAGAGTTACCCCC
AACTCACCCAATCCGTCTAGGTTTGGCTCTTAACTTCTCTGTCTTCTATT
ATGAAATTCAAAACTCTCCAGACAAAGCCTGCCATTTGGCCAAGCAAGCT
TTTGACGACGCTATTGCTGAGTTGGACACTCTGTCTGAAGAATCATACAA
AGATAGCACACTTATCATGCAACTGCTAAGGGACAATTTAACCTTATGGA
CTTCAGACATGTCCGAGTCCGGTCAAGCTGAAGACCAACAACAACAACAA
CAACATCAGCAACAGCAGCCACCTGCTGCCGCCGAAGGTGAAGCACCAAA
GTAA

YER177W, 267 aa (SEQ ID NO 152)
MSTSREDSVYLAKLAEQAERYEEMVENMKTVASSGQELSVEERNLLSVAY
KNVIGARRASWRIVSSIEQKEESKEKSEHQVELICSYRSKIETELTKISD
DILSVLDSHLIPSATTGESKVFYYKMKGDYHRYLAEFSSGDAREKATNAS
LEAYKTASEIATTELPPTHPIRLGLALNFSVFYYEIQNSPDKACHLAKQA
FDDAIAELDTLSEESYKDSTLIMQLLRDNLTLWTSDMSESGQAEDQQQQQ
QHQQQQPPAAAEGEAPK

YOR267C, 2780 bp, CDS: 501-2780 (SEQ ID NO 363)
TAGTTCTATTTGGCTATATATTTCAGAGTGACAAATCTTTAAGAGAGACA
AACTGAGAATTAGCATATAGAATCATTCATACAACTGTTTACAAACAAGT
AAGCCCAAGACAGTTCCCAACCGCTTAAAGAAGTTTTTCCTAGAGGGAGC
AAAGTTCGTTTACATTTCACACACACAGTTTTTTTTCACTTTTTTGGGCC
TCTTCCTTTTCCCGTTTTTTTTCAAAAAGCTTAGAAATCTTCTTCACCTCC
TATTTTTCTAGAATCGTGAAGAATTTCCAGATTTAACAGTTTTCCACTTT
TTCAATAAGGAAATAGTAGGAATAATAAAAAAAGGATAGTAGTAACGATA
TACGTCGACTTTCCAGACTGGTCTCGAGCCGGAATTAAATACAATAGCAG
CGTTTGACTACCACATTGTAGCTCCGCTAGAATTGATCGAAAACAAAAT
AATAACACTAATAATTATAATAATACGGTAGAACTATTTCTCGTATAAAG
ATGCCTAATCTATTGTCGAGAAACCCATTCCATGGTCATCATAATGACCA
TCATCATGACCGTGAAAATTCGTCTAATAACCCGCCACAGTTGATCAGAA
GTTCTAAATCTTTCTTAAACTTCATTGGTAGAAAACAAAGTAATGACTCA
CTAAGAAGCGAGAAATCTACAGATTCCATGAAATCTACCACAACCACTAC
AAATTATACTACAACAAACCTTAATAACAACACCCATAGCCATTCTAATG
CAACCAGTATCTCAACAAACAACTACAATAATAACTATGAAACAAACCAC
CACCATAATATTTCTCATGGGCTCCATGACTATACTTCTCCCGCCTCTCC

AAAACAAACCCACTCCATGGCAGAATTGAAAAGGTTTTTCAGACCTTCTG
TAAATAAAAAACTATCTATGTCTCAACTTCGTTCCAAGAAACATAGCACC
CATTCCCCCCCACCTTCAAAATCAACTTCTACAGTTAATTTAAATAATCA
CTATCGTGCCCAGCATCCTCATGGCTTTACAGACCACTATGCTCATACCC
AGTCTGCTATACCGCCAAGTACCGATTCTATCCTATCTTTGTCCAATAAT
ATTAATATATATCACGATGATTGTATTCTGGCTCAAAAATACGGGAAATT
GGGTAAGTTATTGGGTTCCGGTGCCGGTGGGTCCGTTAAAGTTCTTGTGA
GACCAACTGATGGTGCTACTTTTGCCGTCAAAGAATTCAGACCAAGGAAA
CCGAATGAGAGTGTGAAAGAATATGCCAAGAAGTGCACCGCAGAATTTTG
TATTGGTTCGACTTTACATCACCCAAATGTTATCGAAACTGTTGACGTTT
TCTCTGATTCTAAACAAAATAAATACTATGAAGTTATGGAGTACTGTCCG
ATTGATTTTTTTGCTGTTGTTATGACAGGCAAGATGTCTCGTGGCGAGAT
CAACTGTTGCTTGAAGCAATTGACTGAAGGTGTTAAATATTTACATTCTA
TGGGATTGGCACATAGAGATTTGAAATTGGATAATTGTGTCATGACTTCC
CAGGGTATTTTGAAATTAATTGATTTTGGTAGTGCTGTTGTGTTCAGATA
TCCTTTTGAAGATGGCGTAACGATGGCTCATGGAATCGTGGGTAGTGACC
CTTACTTAGCGCCGGAAGTGATTACCTCCACCAAATCTTATGATCCTCAG
TGCGTCGATATATGGTCTATTGGGATCATATATTGTTGTATGGTGCTTAA
AAGGTTTCCATGGAAAGCCCCTAGAGATTCTGACGATAATTTTAGATTAT
ATTGTATGCCGGATGATATAGAACACGACTATGTTGAATCTGCCAGGCAT
CACGAAGAGTTACTGAAGGAAAGAAAAGAAAAGCGTCAAAGGTTTTTGAA
TCACAGTGACTGTTCCGCCATCAATCAGCAACAACCAGCTCATGAATCAA
ACTTGAAAACAGTTCAAAATCAAGTTCCAAATACTCCAGCATCTATACAG
GGTAAAAGCGATAACAAACCAGACATTGTGGAAGAAGAAACCGAAGAAAA
TAAAGAAGATGATAGCAATAATGATAAAGAAGCACGCCAGATAATGACA
AGGAAAGTACCATCGATATTAAAATAAGCAAAAATGAGAATAAAAGCACG
GTAGTTTCAGCTAACCCAAAGAAAGTAGATGCCGATGCCGACGCTGATTG
CGATGCTAATGGTGACTCTAACGGCAGAGTGGATTGCAAGGCTAACAGTG
ACTGCAATGACAAAACGGATTGTAATGCTAACAATGACTGCAGCAATGAA
TCGGATTGTAACGCTAAAGTTGATACTAACGTCAACACTGCTGCCAACGC
TAACCCTGATATGGTTCCCCAAAACAATCCACAACAACAACAACAACAAC
AACAACAACAACAACAACAACAACAACAACAACAACAACAACACCATCAT
CACCAGCATCAAAATCAAGACAAGGCCCATAGTATCGCTTCCGATAATAA
ATCGAGTCAACAGCACAGAGGACCTCACCATAAAAAAATTATTCATGGCC
CATACCGTCTATTACGTCTACTACCACATGCTTCAAGACCTATCATGTCC
CGTATACTGCAAGTAGATCCAAAGAAAAGAGCAACCTTAGATGATATTTT
TAATGATGAATGGTTTGCCGCCATTGCTGCCTGTACCATGGATTCAAAAA
ATAAAGTTATTAGAGCGCCTGGCCATCACCATACATTGGTTAGGGAGGAA
AATGCTCACTTAGAGACCTACAAGGTTTAA

YOR267C, 759 aa (SEQ ID NO 364)
MPNLLSRNPFHGHHNDHHHDRENSSNNPPQLIRSSKSFLNFIGRKQSNDS
LRSEKSTDSMKSTTTTTNYTTTNLNNNTHSHSNATSISTNNYNNNYETNH
HHNISHGLHDYTSPASPKQTHSMAELKRFFRPSVNKKLSMSQLRSKKHST
HSPPPSKSTSTVNLNNHYRAQHPHGFTDHYAHTQSAIPPSTDSILSLSNN
INIYHDDCILAQKYGKLGKLLGSGAGGSVKVLVRPTDGATFAVKEFRPRK
PNESVKEYAKKCTAEFCIGSTLHHPNVIETVDVFSDSKQNKYYEVMEYCP
IDFFAVVMTGKMSRGEINCCLKQLTEGVKYLHSMGLAHRDLKLDNCVMTS
QGILKLIDFGSAVVFRYPFEDGVTMAHGIVGSDPYLAPEVITSTKSYDPQ
CVDIWSIGIIYCCMVLKRFPWKAPRDSDDNFRLYCMPDDIEHDYVESARH
HEELLKERKEKRQRFLNHSDCSAINQQQPAHESNLKTVQNQVPNTPASIQ
GKSDNKPDIVEEETEENKEDDSNNDKESTPDNDKESTIDIKISKNENKST
VVSANPKKVDADADADCDANGDSNGRVDCKANSDCNDKTDCNANNDCSNE
SDCNAKVDTNVNTAANANPDMVPQNNPQQQQQQQQQQQQQQQQQQQQHHH
HQHQNQDKAHSIASDNKSSQQHRGPHHKKIIHGPYRLLRLLPHASRPIMS
RILQVDPKKRATLDDIFNDEWFAAIAACTMDSKNKVIRAPGHHHTLVREE

NAHLETYKV

YLR110C, 902 bp, CDS: 501-902 (SEQ ID NO 275)
TATTGGCGTCTGATTTCCGTTTTGGGAATCCTTTGCCGCGCGCCCCTCTC
AAAACTCCGCACAAGTCCCAGAAAGCGGGAAAGAAATAAAACGCCACCAA
AAAAAAAAAAATAAAAGCCAATCCTCGAAGCGTGGGTGGTAGGCCCTGGA
TTATCCCGTACAAGTATTTCTCAGGAGTAAAAAAACCGTTTGTTTTGGAA
TTCCCCATTTCGCGGCCACCTACGCCGCTATCTTTGCAACAACTATCTGC
GATAACTCAGCAAATTTTGCATATTCGTGTTGCAGTATTGCGATAATGGG
AGTCTTACTTCCAACATAACGGCAGAAAGAAATGTGAGAAAATTTTGCAT
CCTTTGCCTCCGTTCAAGTATATAAAGTCGGCATGCTTGATAATCTTTCT
TTCCATCCTACATTGTTCTAATTATTCTTATTCTCCTTTATTCTTTCCTA
ACATACCAAGAAATTAATCTTCTGTCATTCGCTTAAACACTATATCAATA
ATGCAATTTTCTACTGTCGCTTCTATCGCCGCTGTCGCCGCTGTCGCTTC
TGCCGCTGCTAACGTTACCACTGCTACTGTCAGCCAAGAATCTACCACTT
TGGTCACCATCACTTCTTGTGAAGACCACGTCTGTTCTGAAACTGTCTCC
CCAGCTTTGGTTTCCACCGCTACCGTCACCGTCGATGACGTTATCACTCA
ATACACCACCTGGTGCCCATTGACCACTGAAGCCCCAAAGAACGGTACTT
CTACTGCTGCTCCAGTTACCTCTACTGAAGCTCCAAAGAACACCACCTCT
GCTGCTCCAACTCACTCTGTCACCTCTTACACTGGTGCTGCTGCTAAGGC
TTTGCCAGCTGCTGGTGCTTTGTTGGCTGGTGCCGCTGCTTTGTTGTTGT
AA

YLR110C, 133 aa (SEQ ID NO 276)
MQFSTVASIAAVAAVASAAANVTTATVSQESTTLVTITSCEDHVCSETVS
PALVSTATVTVDDVITQYTTWCPLTTEAPKNGTSTAAPVTSTEAPKNTTS
AAPTHSVTSYTGAAAKALPAAGALLAGAAALLL

YLR109W, 1031 bp, CDS: 501-1031 (SEQ ID NO 273)
TGTCTATTAGTAATCAAGAAAAGAACCCTAAATCATCGGCGTCCCCTGTG
GGGCTCTCGGAAAAACCGGTCCTGACGTCACTGAAAAGATTTCGGCACAT
GGTCATGGGACCAGAGAAAAATTAATCCGACATGTGGAATATTTCCTTCC
GTTAAGGTAGTGAGCGCGGATTTTTTCTGATTTGTAATTATACGGGGAGC
TCTGGCCAAAAAGGTCAGTATTTGGTGATGAAGTTGAATATCATCTTTTG
ATTTTCTTCTGTATCATTCTTTTTCTTTTTCCACACCCCTTCCGGACGGT
ATTCACATATTGTTGAGAGGTTAAATGAAAAATAAAGGGGTGGAAAATTA
AGGACGAGATGTAAGGGAAAAGCATAAACGAAACATTATATAAAGGAGCA
CAATTTCCTCTCCCTTGCCAATTGTGCATATACCGTTTCTTTATAACGAA
ATTTCAACAAACCAGAACAACACAAGTACTACCAATAACCACAACAAAAC
ATGTCTGACTTAGTTAACAAGAAATTCCCAGCTGGCGACTACAAATTCCA
ATACATTGCTATCAGCCAAAGTGATGCTGACAGTGAATCTTGTAAGATGC
CACAAACAGTTGAATGGTCCAAATTAATTTCTGAAAACAAGAAGGTTATC
ATTACCGGTGCTCCAGCTGCTTTCTCCCCAACCTGTACTGTCAGCCATAT
TCCAGGTTACATCAACTACTTGGATGAATTAGTTAAGGAAAAGGAAGTTG
ACCAAGTGATCGTTGTTACTGTTGACAACCCGTTCGCTAACCAAGCGTGG
GCTAAGAGTTTAGGTGTTAAGGACACCACACACATCAAGTTTGCCTCCGA
CCCAGGCTGTGCTTTCACCAAATCCATTGGTTTCGAATTAGCCGTCGGTG
ACGGTGTTTACTGGAGTGGTAGATGGGCCATGGTTGTTGAAAACGGTATC
GTTACTTACGCTGCCAAGGAAACCAACCCAGGTACCGATGTGACCGTTTC
CTCAGTCGAAAGTGTCTTGGCTCATTTGTAG

YLR109W, 176 aa (SEQ ID NO 274)
MSDLVNKKFPAGDYKFQYIAISQSDADSESCKMPQTVEWSKLISENKKVI
ITGAPAAFSPTCTVSHIPGYINYLDELVKEKEVDQVIVVTVDNPFANQAW
AKSLGVKDTTHIKFASDPGCAFTKSIGFELAVGDGVYWSGRWAMVVENGI
VTYAAKETNPGTDVTVSSVESVLAHL

YBL081W, 1607 bp, CDS: 501-1607 (SEQ ID NO 29)
TTGTTGCAACAATTTTGGGATGCTTCTGCGTCGTACGACCCTGTATTTAC
CTTCTCTAGCTCATCGCTTCCCAGGGTCCACGTTAATTTTTCAATTTTTT
CTTGCGTGTCGAAGATTCAGGTCTCGAGAAATTTGTCAAAAATTTTTCAC
TAGATATTAAGAACTATATACATCGAATAAGATGCCAGCACAGAAGAGAT
AGGCAATCAGTTTAGATACTACAGACACTATCCAATAGTGCAAAGCAAAA
GCAGCATAGAAAAAGAGAATCCCGTTTCCAGCTTTTTCTCTTTTTCCCA
TTCGTTTTTCCTGATCTTTTTTTCTGCATCGTGGCACCTAGAACAAGAGG
TACCTTCCATCCTTCGCTTAATATTTGATACGACTTTTTGATTTCCATT
ATTATTATTTGTTACTATTATTATTTATCATTTGGGTTTCGGTTTTTTGT
AATAATTTTCTTTTTTTTTTTTGGCTCTATTTCACTAAGACATCGTATAT
ATGCCAGGCCAGATAATCAGCATTCCGTTTTTGTCGCAGAACGAGGACAT
GGATAAATACTTGTTGGAGTACCGCAGTTTGAAGCTCCTTCATCAGTCCA
GTAATTCCTTCCAGTCTCACAATGCGCCCTCCCACCAGTCGAACTACCAC
CCCCATTACAATCACATGAAATACAACAACACTGGTAGCTATTACTATTA
CAACAACAACAATAACAGCAGTGTAAACCCACATAACCAAGCTGGTCTAC
AATCCATTAACAGATCTATTCCATCGGCCCGTACGGGCTTACAACCAG
AACAGAGCTAATGACGTACCATATATGAATACCCAAAAGAAACACCACAG
ATTTAGCGCTAACAATAATTTGAACCAGCAAAAATACAAGCAATATCCCC
AGTATACGTCCAATCCAATGGTTACTGCACATCTGAAGCAAACGTACCCT
CAACTGTACTACAATAGCAACGTCAATGCTCACAACAACAACAACAACAG
CAACAACAACAACAACAACAACAACAACAGCAACAACAACAACAATCTTT
ACAACCAGACGCAGTTCTCCACGAGGTACTTCAACTCGAACTCCTCTCCC
TCGTTGACTTCTTCCACTTCTAACTCATCCTCTCCATACAACCAAAGCAC
CTTCGAATACATTTTGCCGTCAACTTCGGCAGCTTCCACAAATTTATCGT
CGTCATCATCAAACAACTCTATGCACACCAACCCAACCACTGCAACATCG
ACATCCGCCGATTTAATCAATGATTTACCCGTGGGCCCCACGTCCAGTTC
GCTTATCTCGGATCTACATTCTCCACCAACTGTATCTTTCCTACCAGCAA
GCCAAACCCTGCTCATGTCCTCCACCACATCTAGCTCTATTGGCACCAAC
ATAAACCCACCGCAACATTCACCATCCCCATCGCAAAGGGAGGATTTTTC
GACGGCACCAGTGAACATGTCTTCGTCCGCATCACTCTTGATGAATGATT
CTTCTTTAGGATGGGGGTCTAACCACATGAACGTATCTTCATCCTCTCAA
CCAGCATCATCAAGACCCTTTGGCATTTGGAATACTGACATGAGCGTTTG
GAGTTGA

YBL081W, 368 aa (SEQ ID NO 30)
MPGQIISIPFLSQNEDMDKYLLEYRSLKLLHQSSNSFQSHNAPSHQSNYH
PHYNHMKYNNTGSYYYYNNNNNSSVNPHNQAGLQSINRSIPSAPYGAYNQ
NRANDVPYMNTQKKHHRFSANNNLNQQKYKQYPQYTSNPMVTAHLKQTYP
QLYYNSNVNAHNNNNNNSNNNNNNNNNNNSNNNNNNLYNQTQFSTRYFNSNSSP
SLTSSTSNSSSPYNQSTFEYILPSTSAASTNLSSSSSNNSMHTNPTTATS
TSADLINDLPVGPTSSSLISDLHSPPTVSFLPASQTLLMSSTTSSSIGTN
INPPQHSPSPSQREDFSTAPVNMSSSASLLMNDSSLGWGSNHMNVSSSSQ
PASSRPFGIWNTDMSVWS

YDR366C, 899 bp, CDS: 501-899 (SEQ ID NO 125)
CTGTCGATATTGGGTTACTTTGTAGTGCATTATTTCCATCAATATTAGCA
GTGTCTTCCAAGGTGAACCATTGCGTGGTAAACCATAGAGTAAAAAACA
AGTGGAAATGGTATCGATTGTATAAAGTACGCAGATTTGCGAAAATACCA
GCAAGTTTGGCTTATGAATCAAATACAGCCCTTGTGAGAATACGATTAAT
GTAAATACCGACCAAAGATATGCTATCCATTGCATAAAATCCAACGGATG
ACCCGTGAACAATGCTAAAATACCATAAGCACCACTGCATTTGTTTAGAA
TGGAAATACCTAAGACAATCTCAACTGCAAGGTATAGCGGCATAAACCCC
AAAAAAGACTATGAAAAAAAATATGTTTGAGAACAGGTTAGTAAAATTG
TGCTTTGCTTCGAATCCTTACAAGTTAACAAAAATTTATAGCGTTTGCCG
GAAACATACTTTTGGAAGGGTTAGAAGAGATGATCTCATAACTAAGGTTA

ATGGTTACAATTGGTAGTTCCTCCCTGGTATTATTTCTTTTTCTTCGTAGT
TTTTGTACAGATCACTTATACAGCTTTACACAGATTTTCCCGCTTGTTGT
GCACTTTTTTTTCGAAGATTATTGAAGAGGGATGCGTTTGGTACAATAAA
AAACATAGGTTCCCAAACCTATATAAATATATATATGTATATGTATATAT
ACTACATATATGCTTTGAGAAATATGTGAATGTTGAGATAATTGTTGGGA
TTCCATTGTTGATAAAGGCTATAATATTAGGTATACAGAATATACTAGAA
GTTCTCCTCAAGGATTTAGGAATCCATAAAAGGGAATCTGCAATTCTACA
CAATTCTATAAATATTATTATCATCATTTTATATGTTTATATTCATTGA

YDR366C, 132 aa (SEQ ID NO 126)
MVTIGSSSLVLFLFFVVFVQITYTALHRFSRLLCTFFSKIIEEGCVWYNK
KHRFPNLYKYIYVYVYILHICFEKYVNVEIIVGIPLLIKAIILGIQNILE
VLLKDLGIHKRESAILHNSINIIIILYVYIH

YDR154C, 851 bp, CDS: 501-851 (SEQ ID NO 101)
TAGACGGGCTTCCACGCGCTTCCACTCATTTCTGTCTCTGGTAATGGCCG
TGGCCCTTCTCACTTTGGTTGGGCTTACGCTGACAAGTGTCTGTTCGATT
CCCTGTATAAATATAAACGTATTCTCTTGAGCCTTCTATCCTTTTGCCAC
TGTCGTCATCATTTGTTCCTCCTTTTTCGCTAGATAGGTTATATTAAGAT
TTGTCTTGAATTTAATATCTCAACTCAATCCAAACTCAACCGCTAATACT
ACCATGTCCCAAGTCTATTTTGATGTCGAAGCTGATGGCCAACCAATTGG
CCGTGTCGTTTTCAAGTTGTACAACGACATAGTCCCAAAGACTGCAGAAA
ACTTCAGAGCTCTATGTACCGGTGAAAAGGGATTCGGCTACGCTGGCTCT
CCATTCCACAGAGTTATTCCAGACTTCATGTTGCAAGGTGGTGACTTCAC
TGCTGGTAACGGTACCGGCGGTAAGTCTATCTACGGTGGCAAATTCCCAG
ATGAAAACTTCAAGAAGCACCACGACAGACCAGGTTTGTTGTCCATGGCC
AACGCCGGTCCAAACACCAACGGTTCTCAATTCTTCATCACCACCGTTCC
ATGCCCATGGTTGGACGGTAAGCATGTTGTCTTTGGTGAAGTTGTTGACG
GTTACGACATCGTTAAGAAGGTTGAGTCCTTGGGTTCTCCTTCCGGTGCC
ACCAAGGCTAGAATTGTTGTTGCCAAGTCCGGTGAATTATAACCGCTCTG
CCTGGAACAATACAGCAAAAATTGAAACGAACTATTCTCTCTTAAATTAT
ATGTATATGTATAAGGTATGTGTATGTATGACAATCAATTCTTATAACTA
A

YDR154C, 116 aa (SEQ ID NO 102)
MKTSRSTTTDQVCCPWPTPVQTPTVLNSSSPPFHAHGWTVSMLSLVKLLT
VTTSLRRLSPWVLLPVPPRLELLLPSPVNYNRSAWNNTAKIETNYSLLNY
MYMYKVCVCMTINSYN

YHR162W, 890 bp, CDS: 501-890 (SEQ ID NO 213)
CGCTCGCTTCCAAGAGTTATCATCATATTCTTCATCATATTCTTCCATAC
TTAAGGTGGGTAGCGAGGACCCCTCAATTCCCCCACCTCTCTGCCAGGGC
GTCATCTTTTTCTACAAAAGCCAGGCTGAGTCACGTCAGTTGCTGACCCT
GGGGGCTGCATTGTTTCCTACGAATTACTCATTTGTTTCGTGCGCTTTCC
TATTGCGCGCATGACTAGGATGGAAAAAAAAGAAGAAAAGAAAAGCGT
TGAGTATATAATAAGAAAGAAGAAAAAGTCCGAGAGAAAAGAAGCACAAA
GGTTTTTCCTCGAGGAAAACAGTAAAGTTTGATACGCACATCGTTGACAT
CGCTGACTGCAATAGGAAACTGAAATAGACGGCAAACCATTAGTTCATTC
GAAAGAACGTATTGTCGAGAATTATCACTCACTATATCAGAAAATTGACA
CACGAATTATATAAACGAAGTTATACAGAAAAAGATTAAAGAAAAGAAA
ATGTCTACATCATCCGTACGTTTTGCATTTAGGCGGTTCTGGCAAAGTGA
GACAGGCCCCAAGACGGTGCATTTCTGGGCTCCTACTTTGAAATGGGGTC
TGGTTTTCGCTGGATTCAGCGATATGAAGAGACCGGTGGAAAAAATTTCT
GGTGCTCAAAATTTGTCGCTGCTATCTACTGCGCTGATTTGGACTCGTTG
GTCCTTTGTCATCAAGCCAAGAAACATCTTGTTGGCTTCTGTCAACTCGT
TTCTTTGTCTGACCGCTGGCTATCAATTGGGTAGAATTGCCAACTACAGG

ATACGGAATGGCGACTCTATATCGCAATTGTGTAGCTATATTCTCAGCGG
CGCCGACGAAAGCAAAAAGGAAATTACTACGGGCAGATAA

YHR162W, 129 aa (SEQ ID NO 214)
MSTSSVRFAFRRFWQSETGPKTVHFWAPTLKWGLVFAGFSDMKRPVEKIS
GAQNLSLLSTALIWTRWSFVIKPRNILLASVNSFLCLTAGYQLGRIANYR
IRNGDSISQLCSYILSGADESKKEITTGR

YGR243W, 941 bp, CDS: 501-941 (SEQ ID NO 189)
CCTCCACCAAAGCAAAATGAAAACAAAGCCATACTGGGAAAAATCTGAAA
AAAAAAATGGTAGGAGTAAAAGAAAAGAAAAAATAAAGGTTACCCTGCAG
TTTGGATAGTCGGGTAACATTTGGCCCTTTTCCTCCTTGATTGGATATTA
TTACCCCGATTACCCCTCATCTTGGGAGTGCCCCGCTTTTATTTCTCCCG
CCAATCGGCTATTAACGGCTTTACGTCATTCCGTGGGCGGGTCAAGCGAG
CCGCTCCCTGGTTTGGTCACGCAAAACCGAAAGGCTCAAACAAAACTAAG
GCCATCATATATATATGCGGCTGCGTGCGTGTATTCTCCCGGATAATA
TGGTGCGTTGCAATTGGAGTATTGGAGAAAATTTTCTTTTCCCTTTCATT
ACGGCGGAAATACTTCATATAAAAAAAAGAATACAATCAGTCTTTAAGA
CTATACGCATAAGCATTCAAGACACATAGAAACACAAACCTATATTTTA
ATGTCAGCATCAGCTTTTAATTTTGCCTTTAGAAGATTTTGGAATAGTGA
AACAGGCCCTAAAACAGTACACTTCTGGGCCCCAACTTTGAAGTGGGGGC
TGGTCTTCGCAGGGCTAAATGATATTAAGAGGCCTGTTGAAGGTATCA
GGAGCACAAAATTTATCTTTATTAGCGACGGCACTGATTTGGACGCGTTG
GTCGTTTGTCATCAAGCCCAAGAACTATCTGTTAGCTTCCGTCAATTTTT
TCCTGGGTTGCACTGCAGGCTACCATCTAACAAGAATTGCTAACTTTAGG
ATACGGAACGGTGATTCTTTTAAACAGGTTATTCACTACATAATAAAAGG
GGAGACTCCTGCAGCCGTCGCAGCAAAGCAAACTGCATCCACATCGATGA
ACAAAGGTGTGATCGGTACTAATCCGCCAATAACGCACTGA

YGR243W, 146 aa (SEQ ID NO 190)
MSASAFNFAFRRFWNSETGPKTVHFWAPTLKWGLVFAGLNDIKRPVEKVS
GAQNLSLLATALIWTRWSFVIKPKNYLLASVNFFLGCTAGYHLTRIANFR
IRNGDSFKQVIHYIIKGETPAAVAAKQTASTSMNKGVIGTNPPITH

YBR050C, 1517 bp, CDS: 501-1517 (SEQ ID NO 43)
AAGTACGATATGGTATAACTGTAACATTGAAGGACTGAAGGACTGAAGGA
CTGAAGGACTATAGTCAAGGGCCAATGGGGAAGGTCCCTTCCAGGCCATT
TGCCCGATAGTTTGTCCTTCTCTTGCTTTTCCGACGGCCCGATTGCATGT
GGCGGGGCAGCACTGGATAAAAAACGTGGGGGGAGTGATTAAATTTATA
CGCTTATTGTGTCAACACGGAAACCTTATAGTTATCATTACTAACATCGC
AACAAGCTGCTTTTTTACTCGTTTTTAGCCACACCATACCCCCTTTAATT
AACTAATAATGCATAAAATAGTTATTGCTTCTTGAGTTGCAGCTTCTTCC
TGGACGTACTGTTATATATGGCATGTCTTCGCATGTCCGTCAAATTTAGC
GTTGTCTCGAAACTTAGGCTGTCGTTCTTGCTGTCTGTCTTCTGATAAAA
TAATATATTGGAATAAGAAAAAAAAATAGGAACAAGAAAGTGTGTGAGA
ATGACTTTGAGTAATTGCGACTCTTTGGATAACTTATTCCAGGACCCTCC
AGAGGAAGAAGAAAGTAGTAAATTCGTTGAGGCGGTCAGAACTTTGATGA
ATAGAAACGATATGGGATATCCTCCCGCCGCTGCAAATGGTACGTATTGC
TTAAAAAAAATCAAGTCTTTGAATGCCAAACAGTGGAAAATAAACAAGAA
AAGAATGTGCATGTTGCCAGCAGTAAGAAGAAAAATTTCGACTTTCACG
AGCAAAGAAGTTTAATCTTGAATTTAAATTTATGGAAATTCATCAAGTTT
ATCAATTGTAGTAGTAAAAACAATTACAATAAAAATAATAAGCATGTGAG
AAGCTCGAACAACACTGTAAAAAATGAAATGTTTTACCGTTACAAAAAC
ACAAGAAAGTGGACAATGATCAAAGATTGGAGAACCTTTTTTGGAGAAGC
TGGTTTAAGGCACGCAAAAGGAGAGATATAATGGGCAAGCCACGAGAGAG
GCATATCAAATTTAACGATAACGTTGAACAGTGTATTATAACTGATGAGC

ATTTCATACAAAGGCTTCCTTCTACACGGTTGAATTCGACTGATGAACAG
CGCCCTTGTTCAAAGTCTGAACTAGATCCCTGTATTGGCAACGCAGCAAG
TAAGCGAAGTTTCTATGATTATAACAGCGTTTACGTCGCGAGTGACGCAA
TTATTACGACTGCCGCTGCCACTGCCATTATCAGTAGTAATAGTGGAGAC
TATCAGCGTGGGCACGATGTTCGCGATGTTCCAAGAAATGTTTGTTACA
GGCAGGAGAAACAGATTTCAGTAGTGTGCTTCGGGTTGACTCCGATCTCA
AGTTATCCAACATAAGTCATCATTCCCCCGTAAAACCTTCGTCAACTTCA
AGTCATTCGACCTTCATTTTCGAGTCGGAAACTGACACTGATACTGATAC
TGACGCTGAAACAGAAAATGACATTGACGCTTACATAGACACCAGTATAC
CCAACCTGCTCCTATAA

YBR050C, 338 aa (SEQ ID NO 44)
MTLSNCDSLDNLFQDPPEEEESSKFVEAVRTLMNRNDMGYPPAAANGTYC
LKKIKSLNAKQWKINKKRMCMLPAVKKKNFDFHEQRSLILNLNLWKFIKF
INCSSKNNYNKNNKHVRSSNNTVKNENVLPLQKHKKVDNDQRLENLFWRS
WFKARKRRDIMGKPRERHIKFNDNVEQCIITDEHFIQRLPSTRLNSTDEQ
RPCSKSELDPCIGNAASKRSFYDYNSVYVASDAIITTAAATAIISSNSGD
YQRGHDVRDVPRNVLLQAGETDFSSVLRVDSDLKLSNISHHSPVKPSSTS
SHSTFIFESETDTDTDAETENDIDAYIDTSIPNLLL

YEL071W, 1991 bp, CDS: 501-1991 (SEQ ID NO 143)
TAGCTTGACCTGGTCAGATTAATCAGCTTCCAACGTTACTTCCCTTTCGC
AAGAATCTACCCAAAATGTCTCGAGCATCTTGATAATTACAGTATCGTTC
GTCCCGACTTGGCATTTGTTTAAATTTCTAAGATGCTTCCTATAGGAACA
TAATTGTCAAGAAAGCACAACAAATTGTCTGCAATGTCAACAGGAGTGGC
GCATTTATGTTTTTTCATTTTTTTTTTTTGTGCGTGATCATTAAGCGG
GATATTGTCCACAGTCATCTAAAAGAATGACCATTTCGACGACTTAGTTC
GGAAAATATTTCCAGCGGATGACACCACTTGCCACAGTTGGTGACCGCCA
AATCTAAGTCACGCGCGGAAACTGAAAGGTTGTGAGTATATAAGTGATCA
CTCGCTTATATAACTGACGAGGCAGAACAGGGTGCCAAAATGCTCCTCAA
TATTTTATTCATTTGAGATTCAAGGCTTAAAGACAGCATATATAAGAATT
ATGACGGCCGCACATCCTGTTGCTCAGTTAACTGCCGAGGCATACCCTAA
AGTCAAGAGAAACCCAAATTTCAAAGTTCTCGACTCGGAAGATTTGGCGT
ACTTTCGTTCGATTTTGTCAAATGATGAAATCTTAAACTCTCAAGCTCCA
GAAGAGCTTGCTTCGTTTAACCAGGACTGGATGAAAAAATATAGAGGCCA
GTCCAATTTAATTCTCTTGCCAAACTCCACTGATAAAGTGTCCAAGATTA
TGAAATACTGTAACGATAAAAAGTTGGCAGTAGTACCACAAGGTGGTAAC
ACCGACTTGGTCGGAGCCTCTGTTCCGGTATTTGATGAGATTGTTCTTTC
TCTAAGAAATATGAACAAAGTCAGAGATTTTGATCCAGTTAGCGGGACTT
TCAAGTGTGACGCGGGTGTCGTTATGCGTGATGCGCATCAATTTTTACAC
GACCATGACCATATCTTCCCATTGGATCTGCCTTCTAGAAACAACTGTCA
AGTGGGCGGTGTAGTTTCAACAAATGCAGGTGGTTTGAACTTTTTAAGAT
ATGGGTCTCTACACGGTAATGTTTTGGGTTTGGAAGTGGTGCTACCCAAC
GGTGAGATTATCAGCAATATCAATGCCCTAAGGAAGGACAATACTGGTTA
TGACTTGAAACAATTATTCATCGGTGCAGAGGGTACTATCGGTGTCGTTA
CTGGTGTATCCATAGTTGCAGCAGCAAAGCCAAAAGCCTTGAATGCCGTA
TTTTTTGGTATTGAGAATTTCGATACCGTTCAGAAATTATTTGTCAAGGC
TAAAAGTGAATTATCTGAGATTTTATCTGCTTTTGAATTCATGGACCGTG
GCTCCATTGAATGTACGATAGAATACTTGAAGGACTTGCCTTTCCCTCTG
GAGAACCAACACAACTTTTATGTTCTTATTGAAACGTCAGGGTCCAATAA
GAGACACGACGATGAGAAGCTGACTGCTTTCCTCAAAGATACCACAGATT
CTAAATTAATTTCGGAGGGTATGATGGCTAAGGACAAAGCCGATTTTGAT
AGACTTTGGACCTGGAGAAAATCTGTTCCAACAGCTTGTAATTCTTACGG
TGGTATGTACAAGTATGACATGTCACTTCAATTGAAAGATTTATATTCCG
TATCTGCGGCTGTGACGGAGAGATTAAACGCAGCCGGTTTGATTGGTGAT
GCACCAAAACCAGTTGTTAAATCATGTGGTTATGGTCATGTCGGTGACGG

```
AAACATCCATTTAAATATCGCGGTAAGAGAATTTACAAAACAGATTGAGG
ACTTACTAGAACCATTTGTTTATGAATATATTGCATCAAAGAAAGGTTCC
ATCAGTGCTGAGCATGGGATCGGTTTCCATAAGAAAGGTAAGTTACACTA
CACCAGAAGTGATATTGAAATTAGATTTATGAAGGATATCAAAAATCACT
ACGATCCAAATGGAATCTTAAACCCATACAAGTACATTTGA
```

YEL071W, 496 aa (SEQ ID NO 144)
```
MTAAHPVAQLTAEAYPKVKRNPNFKVLDSEDLAYFRSILSNDEILNSQAP
EELASFNQDWMKKYRGQSNLILLPNSTDKVSKIMKYCNDKKLAVVPQGGN
TDLVGASVPVFDEIVLSLRNMNKVRDFDPVSGTFKCDAGVVMRDAHQFLH
DHDHIFPLDLPSRNNCQVGGVVSTNAGGLNFLRYGSLHGNVLGLEVVLPN
GEIISNINALRKDNTGYDLKQLFIGAEGTIGVVTGVSIVAAAKPKALNAV
FFGIENFDTVQKLFVKAKSELSEILSAFEFMDRGSIECTIEYLKDLPFPL
ENQHNFYVLIETSGSNKRHDDEKLTAFLKDTTDSKLISEGMMAKDKADFD
RLWTWRKSVPTACNSYGGMYKYDMSLQLKDLYSVSAAVTERLNAAGLIGD
APKPVVKSCGYGHVGDGNIHLNIAVREFTKQIEDLLEPFVYEYIASKKGS
ISAEHGIGFHKKGKLHYTRSDIEIRFMKDIKNHYDPNGILNPYKYI
```

YDR133C, 836 bp, CDS: 501-836 (SEQ ID NO 95)
```
GTGCAGAGGGTGAATCAACGGCCCCTTCACAGAAACCGCGCAGGAATTTT
TCTGGTGTTTGTTATTTTTTTTTCCTTGTACTTATCTCACTTTTCTTTTT
CTAACTATTTTTTTTGCAATTTTTTTGTGTACACTTTCCACAACATATAG
GATGGTTTAGTCATCTCTCGAAGTATATAAACCGTTGCTGGATCGTGGTT
GTTCTTCATCGACTTCTCTCTGCTAGACTCTCTTTTTTAAAATTTTTTCA
TAGAATAAAAAACCAAGGATAACAAACATCTTCTTTCGTTCGCTTCAAAA
TAACTACAAATTAAAAATGCAATTCTCTACCGTCGCTTCTATCGCTGCTA
TTGCCGCTGTTGCCTCCGCCGCTTCTAACATTACCACTGCTACTGTCACA
GAAGAATCTACCACTTTGGTCACTATCACTTCTTGTGAGGACCACGTTTG
TTCTGAAACAGTTTCCCCAGCTTTGGTTTCCACTGCTACCGTCACCGTAA
ATGACGTTATCACTTAATACACCACCTGGTGTCCATTGCCAACCACTGAA
GCACCAAAGAATACCACTTCTCCAGCTCCAACTGAAAAGCCAACCGAAAA
GCCAACTGAAAAGCCAACCCAACAAGGTTCTAGCACTCAAACTGTTACCT
CCTACACTGGTGCCGCTGTTAAGGCTTTGCCAGCTGCCGGTGCTTTGTTG
GCTGGTGCTGCCGCTTTATTGTTGTAATTTACTCAACCTTTTCTTTAATA
TATTTTTAGAAAAATGGTTAAGTACTTTTCCGTCAATACAGCTTCCACAA
AATCGTTTTATTTCAATTAATAAGATATTCTGGTAA
```

YDR133C, 111 aa (SEQ ID NO 96)
```
MTLSLNTPPGVHCQPLKHQRIPLLQLQLKSQPKSQLKSQPNKVLALKLLP
PTLVPLLRLCQLPVLCWLVLPLYCCNLLNLFFNIFLEKWLSTFPSIQLPQ
NRFISINKIFW
```

YHL021C, 1898 bp, CDS: 501-1898 (SEQ ID NO 193)
```
GGTAAAAGAAATGATCAGGGAGCGTTTCTTGCAACAGCAGCAACAGTACA
GGCAGCAACAGCAGAAGGATGGCAATTACGTAAAGCCCTCTCAGGACAAC
GTGGATAGCAAGGACTAACCGAGACAGATTGAGGTCTTTCATGCATTACC
ACCAGTAATAATATTATACGGAATAATATAGTTTATATAATATCCATAAT
CATAATCATAATCATAATCATAATCGTGATATTGTACCAGCCCC
GCTTCTCCCCTTTTGAACTACCATTATTATCGGACCCTCTTTACCTTTGA
ATGGCTCAGTAAGGACCTTTGCGCAGCCGTAAGGGGGTCGGGAATACATT
TCCGGGGTTGATCCTCGAGGAAAAGTGCTATCTATATAAGGAGAAGCCCT
TCTAGATCCAAATATCAGGGGTAACTCTTCACAACTGGCCAGGAACATAT
TCCAAGTTAAAAAGAAAAAATAATTATTAGAAACCAATTACCAACACAAG
ATGCTAAGATCAAATTTATGCAGAGGATCTCGAATCCTTGCAAGACTGAC
CACTACACCAAGGACATACACATCTGCGGCGACAGCTGCGGCTGCGAATC
GGGGACATATCATCAAAACATACTTCAATAGAGATTCTACGACAATTACG
```

TTCTCCATGGAGGAGTCCAGCAAGCCGGTTTCCGTTTGCTTTAACAACGT
TTTTCTTAGAGATGCCTCCCATAGTGCCAAGCTGGTGACCACGGGAGAAC
TGTATCATAACGAGAAATTGACCGCTCCTCAGGACATTCAAATTTCTGAG
GACGGAAAATCTCTAGTGGTGAAATGGAAAGATGGCGGTCATCACCAGTT
CCCTTTACAATTCTTTATCGACTATAAAGGTTCCAGTTTTGTTTCGCCAG
CAACAAGAAAACAAGAATCCAGATATAGACCCCAGTTATGGAATAAGCGC
ATCCTGAAAGATAACGTCAAGGACTTACTTTCTGTGAGCTACAACGAGTT
TATTGATCCTAAGGATGACTCCAAGCTTTTCCAAACGCTGGTCAACCTAC
AAAAGTTTGGTATCGCTTTCATTTCCGGTACTCCTTCATCCTCCTCTGAA
GGCCTTACCATACAAAAGATCTGTGAAAGGATCGGACCCATAAGATCGAC
TGTACATGGTGAAGGTACATTTGACGTGAATGCATCCCAAGCGACAAGTG
TTAATGCCCATTATGCCAATAAAGACTTGCCGCTACATACGGATTTACCA
TTTTTAGAAAATGTGCCAGGTTTCCAGATTCTACAATCTCTACCTGCTAC
AGAAGGGGAAGATCCCAATACTAGACCCATGAATTACTTCGTGGACGCAT
TTTATGCTACCCGTAATGTTAGAGAATCGGATTTTGAGGCTTATGAGGCT
TTACAAATTGTTCCTGTAAATTATATATATGAAAACGGCGATAAGAGGTA
CTACCAATCCAAACCTTTAATCGAACATCACGACATTAACGAGGACAATA
CTCTTCTGGGTAATTATGAGGCCTTGATTAAATGCATTAACTACTCTCCA
CCATACCAAGCACCTTTCACTTTCGGAATTTATGATAAGCCCTCAGATCT
AAATAATAATCTGGACTTGAATTTAATTACCACCCCAGCAAAACTAACAG
AGAGATTTTTGTTTAAGTCTTTCATTAGGGGGTTGAACTTGTTCGAGAGT
CATATCAATGACTTCAACAATCAATTTAGATTGCAGTTGCCCGAAAACTG
TTGTGTTATCTTTAACAACAGGAGAATTTTGCATGCTAACTCTTTAACAA
GCTCAAACCAGCAATGGTTAAAGGGTTGCTATTTCGATTCTGATACTTTC
AAGAGTAAATTAAAGTTCTTGGAAGAGAAGTTTCCTCATGACAAATAA

YHL021C, 465 aa (SEQ ID NO 194)
MLRSNLCRGSRILARLTTTPRTYTSAATAAAANRGHIIKTYFNRDSTTIT
FSMEESSKPVSVCFNNVFLRDASHSAKLVTTGELYHNEKLTAPQDIQISE
DGKSLVVKWKDGGHHQFPLQFFIDYKGSSFVSPATRKQESRYRPQLWNKR
ILKDNVKDLLSVSYNEFIDPKDDSKLFQTLVNLQKFGIAFISGTPSSSSE
GLTIQKICERIGPIRSTVHGEGTFDVNASQATSVNAHYANKDLPLHTDLP
FLENVPGFQILQSLPATEGEDPNTRPMNYFVDAFYATRNVRESDFEAYEA
LQIVPVNYIYENGDKRYYQSKPLIEHHDINEDNTLLGNYEALIKCINYSP
PYQAPFTFGIYDKPSDLNNNLDLNLITTPAKLTERFLFKSFIRGLNLFES
HINDFNNQFRLQLPENCCVIFNNRRILHANSLTSSNQQWLKGCYFDSDTF
KSKLKFLEEKFPHDK

YKL054C, 2717 bp, CDS: 501-2717 (SEQ ID NO 237)
CCTGCTCTAGACGAAGCTAGGGAGGAGGCGCCGTTTGAAAATGGCGGCAA
ACTAAAAGAAGTTGACAAATGAAGTATATATTTTAGCACAGAATGTGCAT
TATTCAACATGTAAATACTAATACTGCAATATCGACTTATAATAATGTAT
AGTGATCCGTATATTAATAGATCTGTTTCAATTCTTTACCTTTTTAGGAT
ATCCGTCACCCGTGATTCCGTCGGAGGTGAGCACTCGCCCAAATAAATAA
CGGGAAATGGTGGCAAAAAGTAGTGGCGGGAAAAGGAAAAATTTTCGTTC
TCTCCCATATAAACGTTTCATTCCTTTTCCTAAGTCTTTTACAGTAATTT
CAGAAACATTCGTATTTTATATTTGATCTTTTGAAGCTACAAGAAAAACT
CTTACCAATTACCCCAAAAAAATCACCATCATAAAGTACTTACATATTTA
TTTTTGTTTGGTCGTTTTCTCAATATAATCTACATCATCATATATATATA
ATGTCTACACAATTTAGGAAGTCTAATCATAATAGTCATAGTAGTAAAAA
ACTAAATCCTGCGCTAAAGTCCAAAATAGATACGCTTACAGAATTGTTCC
CTGACTGGACGAGTGATGATTTAATTGATATAGTTCAAGAATATGATGAT
TTGGAAACTATAATTGATAAAATTACTTCCGGCGCAGTGACAAGATGGGA
TGAAGTAAAGAAACCTGCTAAGAAGGAAAAATATGAAAAAAGGAGCAAC
AACACTCATATGTCCCTCAACAACATTTGCCAAATCCAGAAGATGATATT
ACATATAAGAGTTCTAATAATAGCAATTCTTTTACTTCTACAAAGCATAA

CAGTAGTAACAATTATACTCAAGCCAGAAATAAGAAGAAGGTACAAACAC
CACGAGCTCATACAACCGGGAAACATGTTAATCTCGACAAGGGGAAGCAC
GTACCATCCAAGCCTGTTTCAAACACTACATCGTGGGCAGCAGCTGTTTC
TGTAGATACTAAACATGACGTTCCTCAAGATTCAAATGATAACAATAATG
AAGAATTAGAAGCACAAGGGCAACAAGCGCAGGAGAAAAATCAAGAAAAA
GAGCAAGAAGAGCAACAACAGCAGGAAGGGCATAATAACAAAGAAGAACA
CAAACAAATAGAGCAACCTTCTTTATCTTCAAAGAAAACAACTTCTAGGA
CATCTGCTTCACAACCAAAGAAAATGTCGTGGGCTGCAATTGCTACACCA
AAGCCAAAGGCTGTTAAAAAGACCGAGTCTCCTCTTGAAAACGTTGCTGA
ATTGAAGAAAGAAATAAGCGATATTAAGAAGGATGACCAAAAGTCTGAAG
CTAGTGAAGAAAAAGTTAATGAACAAGAAACATCTGCACAAGAACAAGAG
GAGGAGACTGCTGAACCTTCTGAAGAAAATGAAGACAGAGTCCCTGAAGT
GGACGGAGAAGAAGTCCAAGAAGAAGCTGAAAAAAAGGAACAAGTAAAAG
AAGAGGAACAGACAGCGGAAGAGCTGGAACAAGAACAAGATAATGTTGCT
GCTCCAGAAGAAGAAGTTACAGTTGTTGAAGAAAAGGTTGAAATTAGTGC
TGTTATTTCAGAGCCTCCAGAAGATCAAGCTAATACTGTACCTCAACCAC
AACAACAATCCCAACAACCACAGCAACCACAGCAACCACAGCAACCACAG
CAACCACAGCAACCACAGCAACAACAACAACCACAGCAACCACAACAACC
ACAACAACAACTACAACAGCAACAGCAACAGCAACAACAACCAGTACAAG
CTCAAGCTCAAGCCCAAGAAGAACAATTATCTCAAAACTACTATACTCAA
CAACAGCAGCAACAATACGCTCAACAACAGCATCAGTTACAGCAACAGTA
TTTGTCCCAACAACAACAATATGCTCAGCAACAGCAACAGCATCCACAAC
CTCAATCACAACAACCTCAATCACAGCAAAGTCCACAAAGTCAAAAACAA
GGGAACAACGTGGCTGCCCAACAGTACTACATGTATCAAAACCAATTTCC
TGGATATTCTTATCCAGGTATGTTTGATTCACAAGGATACGCTTACGGTC
AACAATATCAGCAACTTGCTCAAAACAACGCTCAAACTAGTGGTAATGCT
AACCAATATAATTTCCAACAAGGTTATGGTCAAGCAGGCGCGAACACTGC
TGCTGCTAATTTGACTAGTGCTGCCGCTGCTGCTGCCGCTTCTCCAGCTA
CAGCTCACGCCCAACCTCAACAACAACAGCCATACGGTGGCTCATTCATG
CCATACTACGCCCACTTTTACCAACAGTCATTCCCATATGGTCAACCTCA
ATACGGTGTAGCTGGTCAATATCCATACCAGTTACCAAAGAACAATTACA
ACTATTACCAAACTCAAAACGGTCAGGAACAGCAAAGTCCAAATCAAGGT
GTTGCCCAGCATTCTGAAGACTCTCAACAGAAGCAATCACAACAGCAACA
GCAACAGCAACCTCAAGGTCAACCCCAACCTGAAGTTCAAATGCAAAATG
GCCAACCTGTTAACCCACAACAACAAATGCAGTTCCAACAATACTATCAA
TTCCAACAACAACAGCAACAAGCTGCTGCCGCTGCCGCTGCTGCTGCCCA
ACAAGGTGTACCATATGGCTACAACGGTTATGATTACAATTCTAAAAATT
CAAGAGGTTTCTACTAA

YKL054C, 738 aa (SEQ ID NO 238)
MSTQFRKSNHNSHSSKKLNPALKSKIDTLTELFPDWTSDDLIDIVQEYDD
LETIIDKITSGAVTRWDEVKKPAKKEKYEKKEQQHSYVPQQHLPNPEDDI
TYKSSNNSNSFTSTKHNSSNNYTQARNKKKVQTPRAHTTGKHVNLDKGKH
VPSKPVSNTTSWAAAVSVDTKHDVPQDSNDNNNEELEAQGQQAQEKNQEK
EQEEQQQQEGHNNKEEHKQIEQPSLSSKKTTSRTSASQPKKMSWAAIATP
KPKAVKKTESPLENVAELKKEISDIKKDDQKSEASEEKVNEQETSAQEQE
EETAEPSEENEDRVPEVDGEEVQEEAEKKEQVKEEEQTAEELEQEQDNVA
APEEEVTVVEEKVEISAVISEPPEDQANTVPQPQQQSQQPQQPQQPQQPQ
QPQQPQQQQPQQPQQPQQQLQQQQQQQQPVQAQAQAQEEQLSQNYYTQ
QQQQQYAQQQHQLQQQYLSQQQQYAQQQQQHPQPQSQQPQSQQSPQSQKQ
GNNVAAQQYYMYQNQFPGYSYPGMFDSQGYAYGQQYQQLAQNNAQTSGNA
NQYNFQQGYGQAGANTAAANLTSAAAAAASPATAHAQPQQQQPYGGSFM
PYYAHFYQQSFPYGQPQYGVAGQYPYQLPKNNYNYYQTQNGQEQQSPNQG
VAQHSEDSQQKQSQQQQQQQPQGQPQPEVQMQNGQPVNPQQQMQFQQYYQ
FQQQQQAAAAAAAAAQQGVPYGYNGYDYNSKNSRGFY

YLR311C, 848 bp, CDS: 501-848 (SEQ ID NO 283)
ACAAAACAGACTTAGTTATTTTATGGTATACAACAAAAGCTCGAATGAAA
GACGGTTGGCACAAGAGAATTAACAAAATAAACGGAGGAAGAATAAAGTT
ACACCTATTTCTCAAGAATTCTTTTAAATCCGCTCAAGAAAGTTTAAGGG
TATTGCATAAAGAACAGAAACGCCGCTGGAAAAGGCTCTTTGTGCTACTT
CATAATAAATACAGGCAATTTTCTCCACATATTAAAAGGTATTTCGATCA
TTCTTGCCAAAAAGCAAAACAATGTTGGTCGGGATCCAGATTGCAGTTGC
GCAAGCTTCGTTTCAAGTCAATGAAACCATTCCGAGTTTTTCAGTTTAAG
GTTCGCAAAGATACCAACTGGTTTGTAAAGCAGCTGAAACGGTTCGGATT
GAAATTACAGCATTCGAGGATGTATAAAGCGATGTCAGAATGCAGGAAAA
AAAATTATTTTAAGTGCAAACACTAGATCATCCAAAACCCAGCATGAAGA
ATGAAATTAACAAAAGAAAAAAAAAACGACTGCTTAGTAGGAGTGTCATA
TATCCCTCCTTTAAATTTTTTTACACTTACTTTCCTTTTTTTATTGAGAA
TAGAAAAGGTGCATCTCTCTCTCTCTCTCTCTATCTCTATCTCTAAGG
TTTTATTACTTTCATAACGTATGCTATCCATCTCTTTTCCTTTTTTTTTG
TTTTGTTATTCCCTTTTTTTACTCAGTTAGATTCATACTACTATATTTAC
ATATTCTTCGAAGCTTTTATGAGTTAAATATTTTGTTGCTTTATGGGGCA
GAAAATAGTCGACGTCAGTCACCTCCAGGTTATTATGTAATTCGCTAA

YLR311C, 115 aa (SEQ ID NO 284)
MKLTKEKKNDCLVGVSYIPPLNFFTLTFLFLLRIEKVHLSLSLSLSLSLR
FYYFHNVCYPSLFLPFCFVIPFFYSVRFILLYLHILRSFYELNILLLYGA
ENSRRQSPPGYYVIR

YMR107W, 848 bp, CDS: 501-848 (SEQ ID NO 309)
AGAGCAGAAATGATGAAGGGTGTTAGCGCCGTCCACTGATGTGCCTGGTA
GTCATGATTTACGTATAACTAACACATCATGAGGACGGCGGCGTCACCCC
AACGCAAAAGAGTGACTTCCCTGCGCTTTGCCAAAACCCCATACATCGCC
ATCTGGCTCCTGGCAGGGCGGTTGATGGACATCAGCCGCCTCCCTTAATT
GCTAAAGCCTCCACAAGGCACAATTAAGCAATATTTCGGGAAAGTACACC
AGTCAGTTTGCGCTTTTATGACTGGGTTCTAAGGTACTAGATGTGAAGTA
GTGGTGACAGAATCAGGGAGATAAGAGGGAGCAGGGTGGGGTAATGATGT
GCGATAACAATCTTGCTTGGCTAATCACCCCCATATCTTGTAGTGAGTAT
ATAAATAGGAGCCTCCCTTCCTATTGCAACTCCATAAAATTTTTTTTTGT
AGCCACTTCTGTAACAAGATAAATAAAACCAACTAATCGAGATATCAAAT
ATGGGTAGTTTTTGGGACGCATTCGCAGTATACGACAAGAAAAAGCACGC
AGATCCAAGTGTATATGGAGGAAACCATAACAACACAGGAGACAGTAAAA
CGCAGGTTATGTTTTCGAAAGAGTACCGTCAACCTAGGACACATCAGCAA
GAGAACTTGCAGAGCATGAGAAGATCTTCCATAGGATCACAGGACAGTTC
CGATGTTGAGGACGTTAAGGAAGGGAGATTACCCGCAGAAGTAGAAATAC
CAAAGAATGTTGACATCTCTAACATGTCGCAAGGTGAGTTTTTAAGACTT
TACGAAAGTTTGAGGAGGGGGGAACCCGACAATAAAGTAAATAGATAA

YMR107W, 115 aa (SEQ ID NO 310)
MGSFWDAFAVYDKKKHADPSVYGGNHNNTGDSKTQVMFSKEYRQPRTHQQ
ENLQSMRRSSIGSQDSSDVEDVKEGRLPAEVEIPKNVDISNMSQGEFLRL
YESLRRGEPDNKVNR

YKL066W, 944 bp, CDS: 501-944 (SEQ ID NO 243)
GAAAAACATCTCATAAATCATCCCTGGAAAAATGTCTAGTCAAACAGAAA
GAACTTTTATTGCGGTAAAACCAGATGGTGTCCAGAGGGGCTTAGTATCT
CAAATTCTATCTCGTTTTGAAAAAAAAGGTTACAAACTAGTTGCTATTAA
ATTAGTTAAAGCGGATGATAAATTACTAGAGCAACATTACGCAGAGCATG
TTGGTAAACCATTTTTCCCAAAGATGGTATCCTTTATGAAGTCTGGTCCC
ATTTTGGCCACGGTCTGGGAGGGAAAAGATGTGGTTAGACAAGGAAGAAC
TATTCTTGGTGCTACTAATCCTTTGGGCAGTGCACCAGGTACCATTAGAG

GTGATTTCGGTATTGACCTAGGCAGAAACGTCTGTCACGGCAGTGATTCT
GTTGATAGCGCTGAACGTGAAATCAATTTGTGGTTTAAGAAGGAAGAGTT
AGTTGATTGGGAATCTAATCAAGCTAAGTGGATTTATGAATGAATAACTT
ATGGCATGGGAGGGTACATATGAGCGCCTTTTTTTCTCGCTTTGGGCAG
CTCATATCATGTTCCCTCACTAGCTAATAATATAATGAATTTTTTAGAAG
GAGCACGATTATATAAAAAAAATACCACTTATGTTGCTACCCTTATATAC
GAATTTATAATACTTAATGACGCTTCAATGACGCCTGATGTCAAATGCTT
TTGGCTCCCAGTGAAATTGCCACACTTCCTTCTTCTTTCCGAACTTTATA
GTATCATCGAAAAATACAAGTTGGCAAAGGTCTATTACAATCGCGGAACG
TACGATGTTCATACGGTTTCAGCGAATAGTCTTGTAATATCCGGAAGCAT
GCCTACCGGCATTATTATAGGTAGTTCATCGCCCTTGGACTATGTAGGGG
TACAAGTAAATAGGCAACTTGAAATGGATCTCCCTATTGAATGA

YKL066W, 147 aa (SEQ ID NO 244)
MAWEGTYERLFFLALGSSYHVPSLANNIMNFLEGARLYKKNTTYVATLIY
EFIILNDASMTPDVKCFWLPVKLPHFLLLSELYSIIEKYKLAKVYYNRGT
YDVHTVSANSLVISGSMPTGIIIGSSSPLDYVGVQVNRQLEMDLPIE

YML053C, 1139 bp, CDS: 501-1139 (SEQ ID NO 295)
GAGGCGACACCTGCTAATGTTTACAATTTTCCCGATTGGGGTGCTAGAGG
CATACAGTGGGCTACATGGCACAGCACGGCAGTGCAGAGTGAGAAAATAT
GACTTCACGCTCGAGGCGAGGCCACGCTTTCGAAGCTTCGAATGCCACTA
CCTAGACCATTGCTGTTTTGTACCTTCACGGTCCCATTAGAGACATTTTA
CTTAATGCAAGATTGCCATATCCGTTGTCATGGTACCAAACAGGGTAATA
ATTTCTAGAAATCATGATACACGTATGACATCTGGGTAACCTAATCCATC
TGGGTAACCGATTTTTCTCTCCCTTTGCTTTCTCTTTACCACTCAGCTGA
CTTTATTATTTTTTTTATATTTTTCATTTTGACAAAATTATATAGTTAGG
AAGAATACAATAGGACTGCGACAGAAACAGATAAGGGCTCTTTTTTCTTG
GGGTTGGCTGCTTTTATTCATTAATTTAAGACTCAAGTGTGCTGCGTGAA
ATGCTCTCATACTATGAACACAATACTGCGTTCCAAACAAACAATTGCAA
TTCCGGTAGCAATGCCGCCACTACATACAACAGCGACGCCAATAATGATA
CGATCATGAATAAAAGAAAAAATGACCATTTCGAGTTTGATACACACACT
TTCTACCAAAGATCGAAGAGAACAAAACGAGATTCTGTAAGTACAAAGTT
TTCGGTCGGTTCCGGGTGTGCTAATCTTAATAACAACAACAACAACATCA
TCATCAACAACAACAACAACAACAATAATAATAATAATAACCATAATCAT
AATAACAGCAATAATACTGCAACCTACAATAATATTCATTATAAAAAAAA
TATCGAAATATGTCCCCTGAAACCGGTTAGTATGCACCACACTATGAACA
GCCGCTTACTGAACGAATCTGAATTTTATTCTGAAACAGAAGAGTACATG
ATTCATGGTTATTTCGGTAACACTAATCGCGACATAACAGGCACGAGTCC
TACTGGAAGTGCTAGTATTATACAACACCAGTATCATCTTCTACCATCCC
AAAGTATAATTGCATCACAAGCACCCGGTACTGCCATGGCCGCGTTGACT
AACAACAATATCGCTAACGATTACATGGATATAGATTAA

YML053C, 212 aa (SEQ ID NO 296)
MLSYYEHNTAFQTNNCNSGSNAATTYNSDANNDTIMNKRKNDHFEFDTHT
FYQRSKRTKRDSVSTKFSVGSGCANLNNNNNNIIINNNNNNNNNNNNNHNH
NNSNNTATYNNIHYKKNIEICPLKPVSMHHTMNSRLLNESEFYSETEEYM
IHGYFGNTNRDITGTSPTGSASIIQHQYHLLPSQSIIASQAPGTAMAALT
NNNIANDYMDID

YOR121C, 806 bp, CDS: 501-806 (SEQ ID NO 355)
GGTGACGCTGTTTGGGCTACTTCTGGTGGCCTATCTTTGCAACCAAACGA
AATTGGTGAAATTGTTCAAGGCTTCGACAATCCAGCTGGTTTGCAAAGCA
ATGGTTTGCATATTCAAGGCCAAAAGTTCATGTTGTTGAGAGCTGACGAT
AGAAGTATCTACGGTAGACATGATGCTGAGGGTGTTGTTTGTGTAAGAAC
TAAGCAAACCGTTATTATTGCTCATTATCCACCAACCGTACAAGCCGGTG

AGGCCACCAAGATTGTCGAGCAATTGGCTGACTACTTGATTGGTGTTCAA
TACTAATTTATGCAGGTAAAGTTTTCTTGCCTTATACACCACCTATTCTG
GCATCTGCGGGATTTCGCTTCCTATTTTACAAATATTTTATTGATTGACG
CTAATTATCACTGTAAAAGGCGCACTTTTTATATGTAGTCACATCCGGTA
TTTAACATATTTACGAAACAGTCTTAAGAATATCGACATTTGATATACTT
ATGTTTAATTTATCTACATATTACAATCATACGAGAAACACGCAAAAACA
ATTACTTGAATACTTCGAAAGGAGACCAATTTGGATGTACAACCCTTTTT
TCGCCCTTTTCCTTCGATATGTTATTGATAGCTTCAAAGTCCTCAGTAGA
CAAAGTAAATATTTTCCTGTTCGTTTTGATTCGATCGGGATTCACAGATT
TTGGCAAGACAACATAACCTCTTTGGACGTGCCAGCTAATAACAACGTGT
CCGGGTTGAACGTTATTTTTCTTCGCAATTTCAAGGATAACCGGTTCCTT
CAATAG

YOR121C, 101 aa (SEQ ID NO 356)
MFNLSTYYNHTRNTQKQLLEYFERRPIWMYNPFFALFLRYVIDSFKVLSR
QSKYFPVRFDSIGIHRFWQDNITSLDVPANNNVSGLNVIFLRNFKDNRFL
Q

YOL106W, 854 bp, CDS: 501-854 (SEQ ID NO 341)
ATATGGTTTCATCATTTTGCTCAATTGTTCTCCATTTGGGTTACCTTTTT
TGCCAGTTGGTCGTACTTGAGGTTTTTCCAGAAACTTGCACCCTTGAATT
GTCCCTCTTTGCCAACAACTAATTCTCAAGGTGGTCAGGAAATATTGGTC
GGCGATGCATCTGATACTTTTCAATTGATTTACTTCTTTCCTGATCTAAT
TAAGCCGATTTTGAGGCCGATTTTCAATTTCATTTATAATGTAGTTGTTG
TAAAATTTAAAGTCATTAAACCTTTTCATGATATTGATATAGATATTGGG
AACACCATCGCAGAAAGTAGAGGCGCCAAAAAAATTATGACTGTAGAAGA
AAGACGAAGACAGTTAGCTTTACAAGTTTTGGAAGAGCGTATGGTAAACC
CTTGATATATGGATCTATATAACTTGAAATATGCTCTATTATATCGTGAT
TTAATGACGGCTGTTGGCATTTCGGTCTTTACCAAGGTAGTAGGATTTGT
ATGCTGAATGTGCGCCAGTACTATCGAACCATAGAAACCCATATATTCCC
CAATATTAATAATTCTACTGAGAAATGGGTGAATTTTGAAATAATTGTTG
GGATTCCATCGTTGATAAAGGCTATAATATTAGGTATACAGAATGTACTA
GAAGTTCTCCTCGATGATATAGGAATCCCCATAATGGAATCTATATTTCT
ATGTACCAATATTACGATTATTCCTCATTCCATTTCATATGTTTCATTAT
CCTATTACATTATCGATCCTTGCATTTCAGCTTCCTCTAACTTCGGTGAC
AGCTTCTATAATAACTTATGTCACTATCTAACACCGTATATGATAATATA
TTGA

YOL106W, 117 aa (SEQ ID NO 342)
MLNVRQYYRTIETHIFPNINNSTEKWVNFEIIVGIPSLIKAIILGIQNVL
EVLLDDIGIPIMESIFLCTNITIIPHSISYVSLSYYIIDPCISASSNFGD
SFYNNLCHYLTPYMIIY

>YAL003W, 1487 bp, exon1: 501-580, intron1: 581-946, exon2:
947-1487 (SEQ ID NO 17)
CCGATGGAACGTTCTGGAAAAAGAAGAATAATTTAATTACTTTCTCAACTAAAATCTGGA
GAAAAACGCAAATGACAGCTTCTAAACGTTCCGTGTGCTTTCTTTCTAGAATGTTCTGG
AAAGTTTACAACAATCCACAAGAACGAAAATGCCGTTGACAATGATGAAACCATCATCCA
CACACCGCGCACACGTGCTTTATTTCTTTTTCTGAATTTTTTTTTTCCGCCATTTTCAAC
CAAGGAAATTTTTTTTCTTAGGGCTCAGAACCTGCAGGTGAAGAAGCGCTTTAGAAATCA
AAGCACAACGTAACAATTTGTCGACAACCGAGCCTTTGAAGAAAAATTTTTCACATTGT
CGCCTCTAAATAAATAGTTTAAGGTTATCTACCCACTATATTTAGTTGGTTCTTTTTTTT
TTCCTTCTACTCTTTATCTTTTTACCTCATGCTTTCTACCTTTCAGCACTGAAGAGTCCA
ACCGAATATATACACACATAATGGCATCCACCGATTTCTCCAAGATTGAAACTTTGAAAC
AATTAAACGCTTCTTTGGCTGACAAGTCATACATTGAAGGGTATGTTCCGATTTAGTTTA CTTTATAGATCGTTGTTTTTCTTTCTTTTTTTTTTTCCTATGGTTACATGTAAAGGGAA
GTTAACTAATAATGATTACTTTTTTTCGCTTATGTGAATGATGAATTTAATTCTTTGGTC
CGTGTTTATGATGGGAAGTAAGACCCCCGATATGAGTGACAAAAGAGATGTGGTTGACTA
TCACAGTATCTGACGATAGCACAGAGCAGAGTATCATTATTAGTTATCTGTTATTTTTT
TTCCTTTTTTGTTCAAAAAAAGAAAGACAGAGTCTAAAGATTGCATTACAAGAAAAAAGT
TCTCATTACTAACAAGCAAAATGTTTTGTTTCTCCTTTTAAAATAGTACTGCTGTTTCTC
AAGCTGACGTCACTGTCTTCAAGGCTTTCCAATCTGCTTACCCAGAATTCTCCAGATGGT
TCAACCACATCGCTTCCAAGGCCGATGAATTCGACTCTTTCCCAGCTGCCTCTGCTGCCG
CTGCCGAAGAAGAAGAAGATGACGATGTCGATTTATTCGGTTCCGACGATGAAGAAGCTG
ACGCTGAAGCTGAAAAGTTGAAGGCTGAAAGAATTGCCGCATACAACGCTAAGAAGGCTG
CTAAGCCAGCTAAGCCAGCTGCTAAGTCCATTGTCACTCTAGATGTCAAGCCATGGGATG
ATGAAACCAATTTGGAAGAAATGGTTGCTAACGTCAAGGCCATCGAAATGGAAGGTTTGA
CCTGGGGTGCTCACCAATTTATCCCAATTGGTTTCGGTATCAAGAAGTTGCAAATTAACT
GTGTTGTCGAAGATGACAAGGTTTCCTTGGATGACTTGCAACAAAGCATTGAAGAAGACG
AAGACCACGTCCAATCTACCGATATTGCTGCTATGCAAAAATTATAA >YAL003W, 206 aa (SEQ ID NO 18)
MASTDFSKIETLKQLNASLADKSYIEGTAVSQADVTVFKAFQSAYPEFSRWFNHIASKAD
EFDSFPAASAAAAEEEEDDDVDLFGSDDEEADAEAEKLKAERIAAYNAKKAAKPAKPAAK
SIVTLDVKPWDDETNLEEMVANVKAIEMEGLTWGAHQFIPIGFGIKKLQINCVVEDDKVS
LDDLQQSIEEDEDHVQSTDIAAMQKL >YAL060W, 1649 bp, CDS: 501-1649 (SEQ ID NO 19)
AAAGACTACGAGAATCAATAAACGAGGCTAAACTGCGTCACACATGATTGTGATTGAGTA
CTCACGTTCTCGTGTTAATCCCGCGGTCTTCTTGTTTTACTAACTTTTCTTTCTCTCATA
GCATTCTCTTGACAGTGTTTTATATACATCATATGTACATTTATCGAGCCAATCGAGGGC
AGCAGTTTAACATCAAGCCGGATTTGCTCACGCTACTTTGACCCCTTTTCGTTTCGACGG
AGAGAAGAAACCGGTGTTTTCCTATCCTTGCCTATTCTTTCCTCCTTACGGGGTCCTAGC
CTGTTTCTCTTGATATGATAATAGGTGGAAACGTAGAAAAAAAAATCGACATATAAAGT
GGGGCAGATACTTCGTGTGACAATGGCCAATTCAAGCCCTTTGGGCAGATGTTGCCCTTC
TTCTTTCTTAAAAAGTCTTAGTACGATTGACCAAGTCAGAAAAAAAAAAAAAAGGAACT
AAAAAAAGTTTTAATTAATTATGAGAGCTTTGGCATATTTCAAGAAGGGTGATATTCACT
TCACTAATGATATCCCTAGGCCAGAAATCCAAACCGACGATGAGGTTATTATCGACGTCT
CTTGGTGTGGGATTTGTGGCTCGGATCTTCACGAGTACTTGGATGGTCCAATCTTCATGC
CTAAAGATGGAGAGTGCCATAAATTATCCAACGCTGCTTTACCTCTGGCAATGGGCCATG
AGATGTCAGGAATTGTTTCCAAGGTTGGTCCTAAAGTGACAAAGGTGAAGGTTGGCGACC
ACGTGGTCGTTGATGCTGCCAGCAGTTGTGCGGACCTGCATTGCTGGCCACACTCCAAAT
TTTACAATTCCAAACCATGTGATGCTTGTCAGAGGGGCAGTGAAAATCTATGTACCCACG
CCGGTTTTGTAGGACTAGGTGTGATCAGTGGTGGCTTTGCTGAACAAGTCGTAGTCTCTC
AACATCACATTATCCCGGTTCCAAAGGAAATTCCTCTAGATGTGGCTGCTTTAGTTGAGC
CTCTTTCTGTCACCTGGCATGCTGTTAAGATTTCTGGTTTCAAAAAAGGCAGTTCAGCCT
TGGTTCTTGGTGCAGGTCCCATTGGGTTGTGTACCATTTTGGTACTTAAGGGAATGGGGG
CTAGTAAAATTGTAGTGTCTGAAATTGCAGAGAGAAGAATAGAAATGGCCAAGAAACTGG
GCGTTGAGGTGTTCAATCCCTCCAAGCACGGTCATAAATCTATAGAGATACTACGTGGTT
TGACCAAGAGCCATGATGGGTTTGATTACAGTTATGATTGTTCTGGTATTCAAGTTACTT
TCGAAACCTCTTTGAAGGCATTAACATTCAAGGGGACAGCCACCAACATTGCAGTTTGGG
GTCCAAAACCTGTCCCATTCCAACCAATGGATGTGACTCTCCAAGAGAAAGTTATGACTG
GTTCGATCGGCTATGTTGTCGAAGCCTTCGAAGAAGTTGTTCGTGCCATCCACAACGGAG
ACATCGCCATGGAAGATTGTAAGCAACTAATCACTGGTAAGCAAAGGATTGAGGACGGTT
GGGAAAAGGGATTCCAAGAGTTGATGGATCACAAGGAATCCAACGTTAAGATTCTATTGA
CGCCTAACAATCACGGTGAAATGAAGTAA >YAL060W, 382 aa (SEQ ID NO 20)
MRALAYFKKGDIHFTNDIPRPEIQTDDEVIIDVSWCGICGSDLHEYLDGPIFMPKDGECH
KLSNAALPLAMGHEMSGIVSKVGPKVTKVKVGDHVVVDAASSCADLHCWPHSKFYNSKPC
DACQRGSENLCTHAGFVGLGVISGGFAEQVVVSQHHIIPVPKEIPLDVAALVEPLSVTWH AVKISGFKKGSSALVLGAGPIGLCTILVLKGMGASKIVVSEIAERRIEMAKKLGVEVFNP
SKHGHKSIEILRGLTKSHDGFDYSYDCSGIQVTFETSLKALTFKGTATNIAVWGPKPVPF
QPMDVTLQEKVMTGSIGYVVEAFEEVVRAIHNGDIAMEDCKQLITGKQRIEDGWEKGFQE
LMDHKESNVKILLTPNNHGEMK >YBL058W, 1772 bp, CDS: 501-1772 (SEQ ID NO 23)
TTATTTACATAGTGCCATTGAACACTTTTCAAGCAAACTACGCCAGCCGGACGCAGACAA
TAACACACACACAAAAGAGTCTTGCAGGTTCTCTTTTAGCGGCAACGGGCATGACACTAG
GTATATTTGGTATGGGCATCACAGGGACATGTTGGAGCTGGGATGTTTCATCATTTCAGG
AACTAAAGCAACGTCTGGAAAGGCGTGCCAACAACGAATTTGTAGTGACAAACATGCCTC
TGGATAAAAGAAGCCAGCAAGTAGTGGACAGCTTAGTTAAGACACACAATTCATCTCTTT
GTAAATAGTGTTATACCATAGTAGTAGTTTCAATAATATATTCCACTACTTATATGTGTT
ACCCGCATTAGAACTCTTATTGGTGGCGAAAATCGATGGCAATAAAGAACGGAAGGGGTT
TAATAGTTGTATGCTTAACATATTTCGATTTAAATATATAAGAAACGTCGGTAGCACAAC
AATTAACTCATTATTTAGGTATGGCGGAAATACCTGATGAAACCATCCAGCAGTTCATGG
CATTGACCAATGTGTCGCATAACATAGCCGTTCAATATCTCTCTGAATTTGGAGATTTAA
ATGAAGCACTAAATTCCTATTATGCTTCTCAAACGGATGACCAAAAGGATAGAAGAGAGG
AAGCACATTGGAACAGACAGCAGGAGAAGGCCCTCAAGCAAGAAGCCTTCTCCACCAACT
CTTCGAATAAAGCCATAAATACGGAGCACGTTGGTGGGTTATGTCCAAAACCAGGATCCT
CACAAGGTAGCAACGAGTACTTGAAAAGGAAAGGTTCTACCTCTCCTGAACCAACCAAGG
GTAGTAGCCGCTCTGGAAGTGGTAACAACTCCAGGTTTATGAGCTTTTCGGATATGGTAA
GAGGTCAAGCTGATGATGACGATGAAGATCAACCGAGAAATACTTTTGCTGGTGGTGAAA
CATCCGGCTTAGAGGTTACAGATCCTTCAGATCCTAATTCATTACTGAAGGATTTGCTGG
AAAAAGCGAGAAGGGGTGGTCAAATGGGCGCTGAAAACGGATTCCGTGATGACGAAGACC
ATGAAATGGGTGCCAATAGGTTTACTGGAAGAGGTTTTAGATTAGGGTCAACCATCGACG
CAGCAGATGAAGTCGTAGAAGACAACACTTCACAATCACAACGTAGACCAGAAAAAGTCA
CAAGAGAAATTACATTTTGGAAGGAAGGTTTTCAAGTGGCCGATGGTCCGCTTTATCGCT
ATGATGATCCTGCGAACAGTTTCTATTTGAGCGAGTTAAATCAAGGGAGGGCTCCATTAA
AGCTCTTAGATGTGCAATTTGGACAAGAAGTTGAAGTTAATGTATATAAAAAATTAGATG
AGTCTTATAAAGCTCCGACGAGAAAACTGGGCGGTTTTTCAGGCCAGGGCCAAAGACTAG
GATCTCCTATCCCGGGTGAATCGTCACCTGCGGAGGTTCCAAAGAATGAGACACCCGCTG
CTCAGGAACAACCCATGCCGGACAATGAGCCAAAACAAGGCGACACCTCCATCCAAATTA
GATACGCAAATGGCAAAAGAGAAGTTTTGCACTGCAATTCCACAGATACAGTAAAGTTTT
TGTATGAGCATGTGACATCAAATGCGAACACTGACCCATCGAGGAATTTCACCTTGAATT
ATGCCTTTCCTATCAAACCAATAAGCAACGATGAGACAACATTGAAGGACGCTGATCTGC
TGAACTCCGTTGTCGTGCAAAGATGGGCATGA >YBL058W, 423 aa (SEQ ID NO 24)
MAEIPDETIQQFMALTNVSHNIAVQYLSEFGDLNEALNSYYASQTDDQKDRREEAHWNRQ
QEKALKQEAFSTNSSNKAINTEHVGGLCPKPGSSQGSNEYLKRKGSTSPEPTKGSSRSGS
GNNSRFMSFSDMVRGQADDDDEDQPRNTFAGGETSGLEVTDPSDPNSLLKDLLEKARRGG
QMGAENGFRDDEDHEMGANRFTGRGFRLGSTIDAADEVVEDNTSQSQRRPEKVTREITFW
KEGFQVADGPLYRYDDPANSFYLSELNQGRAPLKLLDVQFGQEVEVNVYKKLDESYKAPT
RKLGGFSGQGQRLGSPIPGESSPAEVPKNETPAAQEQPMPDNEPKQGDTSIQIRYANGKR
EVLHCNSTDTVKFLYEHVTSNANTDPSRNFTLNYAFPIKPISNDETTLKDADLLNSVVVQ
RWA >YBR039W, 1436 bp, CDS: 501-1436 (SEQ ID NO 41)
TTGAGATTTTCCAAGTAGTAACTCATCTTTCTGAGTGTGCTATCAAATACATACTAAGGA
GAATAAACTCTTGTTATTACGTATTCTTCATCCTTATGGGTAGAGAGCGCACTGTTTTAG
TACATTTTCTAGACGTCGAAACGTAGAGCAATTGTCGATAAAACAAAAAAAAAGTAAGAA
GATATATGAATAGGACGTGTCGCTAGAACTAGTAAGTATATGATGGAGATATAATAAGTG
AATTATTCGATATTTAATGAACGTTCTCATTTATTTGGAAGAAATGTTTATCACGTGATG
GAGAACCAATGAGCGGCGAGTAACTACGCGAGGAACCCGGACCGCAATAACGATTAAAGA
AGGCCCGGAAGGGAGATGCTTAAATGATTATCACTCAGTTAAAAAAGACAAATAAGAAAC
TATTGAGACTGAACCGTTTTGGTTAATTTCAGGTGGAAACAATTGAAGACGAGCAGTAAA CATTATTTTATTTAGTAGTCATGTTGTCAAGAATTGTATCAAACAATGCAACACGCTCCG
TAATGTGCCACCAAGCGCAAGTGGGTATTCTTTATAAGACTAACCCAGTGAGAACTTATG
CTACTTTGAAAGAAGTGGAAATGCGTTTGAAATCTATCAAAAATATTGAGAAGATCACAA
AAACTATGAAGATTGTTGCATCTACAAGATTGAGTAAAGCTGAAAAGGCTAAAATTTCCG
CAAAGAAGATGGATGAAGCAGAGCAGTTGTTTTACAAGAACGCCGAAACCAAAAATTTGG
ATGTTGAGGCTACTGAAACAGGTGCTCCTAAAGAGTTGATTGTTGCTATCACCTCTGATA
AGGGGTTGTGTGGTTCTATCCACTCTCAATTGGCTAAAGCTGTGAGAAGACATTTGAATG
ATCAACCAAACGCCGATATAGTCACTATTGGTGATAAAATTAAAATGCAGCTATTGAGAA
CCCATCCTAACAACATTAAATTGTCTATTAATGGAATTGGTAAAGATGCCCCAACTTTCC
AAGAATCTGCTTTGATTGCCGATAAGTTATTGAGTGTCATGAAGGCCGGCACTTACCCAA
AGATTTCCATTTTCTACAATGACCCAGTGTCTTCCCTATCTTTTGAACCATCTGAAAAAC
CGATCTTTAACGCCAAGACCATTGAACAATCCCCATCATTCGGCAAATTTGAGATCGACA
CGGACGCAAACGTTCCAAGAGATTTGTTTGAATATACTTTGGCTAACCAAATGTTGACAG
CAATGGCTCAAGGTTATGCTGCTGAAATTTCCGCCAGAAGAAACGCTATGGATAACGCTT
CCAAGAATGCCGGTGATATGATCAATCGTTACTCTATCTTGTACAACAGAACAAGACAAG
CTGTCATTACTAATGAACTGGTTGATATTATTACTGGTGCTTCCTCTTTGGGATGA >YBR039W, 311 aa (SEQ ID NO 42)
MLSRIVSNNATRSVMCHQAQVGILYKTNPVRTYATLKEVEMRLKSIKNIEKITKTMKIVA
STRLSKAEKAKISAKKMDEAEQLFYKNAETKNLDVEATETGAPKELIVAITSDKGLCGSI
HSQLAKAVRRHLNDQPNADIVTIGDKIKMQLLRTHPNNIKLSINGIGKDAPTFQESALIA
DKLLSVMKAGTYPKISIFYNDPVSSLSFEPSEKPIFNAKTIEQSPSFGKFEIDTDANVPR
DLFEYTLANQMLTAMAQGYAAEISARRNAMDNASKNAGDMINRYSILYNRTRQAVITNEL
VDIITGASSLG >YBR062C, 848 bp, CDS: 501-848 (SEQ ID NO 45)
CCATTTTGGTGACCAACTCTCCTACCCGAATTACTGTGATGATATATACTCTTCGTTTTC
TAGTAATGGCTTCATTTTGCCTAAGTTGGTCAAAATTGTTGTGGGCGGCTTTTGTTTGCA
CCGAGGAGCGCTCAGTTCGTTATAATACCAGTTTTGCCACTCCTAAACTACTAAAGAAAT
AATAGAAGATATATTCATCAAACATAATCACAATCAAAAAAATGTCTACATATGAAGGT
ATGTAATGATATATTATGAAGTAAGTTCCCCAAAGCCAATTAACTAACCGAATTTTAATC
TGCACTCATCATTAGATTAGAGGAACATGGAATACAACAAAACTCAAGGGATTACCAAGA
AGTAGGAGGAACTTCACAGGAGGAGCAGAGAAGACAGGTCAAGATCCCAACTGCAAGGTC
TATTTCAAAACTTTGGTAACACCAGTGGTGAGGGTGATGCACATTCAGATTCAACACTAC
TTTTACGATTATTATCGCAAATGCTTCCAGAATCATTACAGGAAGAATGGTTGCAAGAAA
TGGATAAAGGCAAGAGTGCGGGCTGTCCTGATACTTTTGCAGCCTCTTTACCACGAATCA
ATAAAAAAAGCTCAAAGCAACTGACAACTGCTCCATTTGTTACACTAATTATTTAGAAG
ATGAGTACCCCTTAGTAGTTGAATTACCTCATTGCCATCATAAGTTCGACTTAGAGTGTT
TGTCTGTCTGGCTATCTCGAAGTACAACATGTCCATTATGCAGAGATAATGTTATGGGCC
ACCGAATCATTAATGAGATTGATACAACTGAAGCAGAACTGGAAGAAGATTGGGGTATGT
ACGGTTAA >YBR062C, 115 aa (SEQ ID NO 46)
MLPESLQEEWLQEMDKGKSAGCPDTFAASLPRINKKKLKATDNCSICYTNYLEDEYPLVV
ELPHCHHKFDLECLSVWLSRSTTCPLCRDNVMGHRIINEIDTTEAELEEDWGMYG >YBR101C, 1373 bp, CDS: 501-1373 (SEQ ID NO 49)
AATGATGAAATGTTATCCCCAGGGTCCATTAAGTCATCCAGAAAACAGATAGATGGATTG
AAGGCCGTAGGTTTGGATTTTGTCTACAAATTGGACGAGTTTATCAAAAAGAACAGTGAT
AAAATTCGCTAAACAAGATCACAGAAATAAACCTCACTTCAATATATATGATGTGTAGG
TAGGGTATATACTTATACCACTGCTGTCGACAGTGTACTAACCTATTTCCTATTTTGTAG
GTAAGCTTTTCAGCTACTGGTTGGTCAAGTTGGGCCCTATTAAGGTTGTAATCAGCTTAT
TCGTTTGAAATGATATACCTCTTGGACTGGAATCTTCTGGAAGTTTTTGGAGGTTAGAA
AAGAGGAAGGCATCTCGCGCTGACAGAAATTTGCTTATAAACCAGCGATTGGCTATATCT
AAAAGAGCACTCATCGTCAGTCAGAAAGCCATTACCTTTCAACGAAGAGTAAAATAGAA
AAAAAAACACATACATAACTATGGAAAAGCTATTACAGTGGTCTATTGCGAATTCTCAAG

```
GGGACAAAGAAGCTATGGCTAGGGCCGGCCAACCTGATCCTAAATTGCTACAGCAGTTAT
TCGGTGGTGGTGGTCCTGACGATCCAACCTTAATGAAAGAATCCATGGCTGTTATTATGA
ATCCGGAGGTTGACTTAGAAACAAAACTCGTTGCATTTGACAACTTTGAAATGTTGATTG
AGAACTTAGATAATGCTAATAATATCGAAAATTTAAAACTGTGGGAGCCATTGTTGGATG
TTCTTGTTCAGACGAAGGATGAAGAACTACGTGCTGCTGCTTTATCCATTATTGGAACGG
CTGTGCAAAACAACTTGGATTCGCAAAATAATTTCATGAAATACGACAATGGTCTGCGAA
GCCTTATCGAAATAGCTAGTGACAAGACAAAGCCACTCGACGTGAGAACAAAAGCTTTTT
ACGCACTATCTAATCTAATAAGAAACCACAAAGATATCTCAGAAAAGTTTTTCAAATTAA
ATGGGCTCGACTGCATAGCACCTGTATTAAGTGATAACACCGCCAAACCAAAACTGAAAA
TGAGAGCCATTGCCTTATTGACCGCATATTTGTCATCTGTTAAGATTGATGAAAATATAA
TCAGTGTGCTGAGAAAGGATGGAGTAATTGAAAGTACGATTGAGTGCTTGTCTGACGAGA
GTAACTTGAACATCATAGATAGAGTTCTGTCTTTTCTCTCTCACCTGATATCTTCCGGAA
TAAAATTTAATGAACAGGAATTGCACAAATTGAACGAAGGTTACAAACATATCGAGCCTC
TAAAGGACAGACTTAATGAAGACGATTATTTAGCCGTAAAGTATGTATTATGA

>YBR101C, 290 aa (SEQ ID NO 50)
MEKLLQWSIANSQGDKEAMARAGQPDPKLLQQLFGGGGPDDPTLMKESMAVIMNPEVDLE
TKLVAFDNFEMLIENLDNANNIENLKLWEPLLDVLVQTKDEELRAAALSIIGTAVQNNLD
SQNNFMKYDNGLRSLIEIASDKTKPLDVRTKAFYALSNLIRNHKDISEKFFKLNGLDCIA
PVLSDNTAKPKLKMRAIALLTAYLSSVKIDENIISVLRKDGVIESTIECLSDESNLNIID
RVLSFLSHLISSGIKFNEQELHKLNEGYKHIEPLKDRLNEDDYLAVKYVL

>YBR139W, 2027 bp, CDS: 501-2027 (SEQ ID NO 55)
GGAGGAGTCAAGGGCCTGGAAAGTACGGATCCTGTAGAAATATCACTGGCAATTATACTG
AGTTTATTGTTGGTGTTGCTATTCATATTTGAGCTGGTATTGGACGAAAGCAAGGATAAT
GAGTTTGTGTCTACTGACTCCAACACCCTAGGCTGGATTTGATCTTTCTCCATCCTTTAA
TTTTAACCTTTTAATTAGTGGTTGGATCAAGTTTTCGAGACTATTCCAATCTGTGACTTG
TTGGATAAATAGTTTTTGACTCGTTTAGTATAATCCTTTTTTCTAAAAGTGCTTAGAGTT
CTCTAAGATGTTCTTGTTTACAATGTGAGCGATTTAGGAAATTTCCTAAAAATGGCCGAG
GCGGCGCTAGCATTCTACGAAGGTGAGATAACGCTTCGTTATCGAAAAATGTCAGGGGA
CAGGGGTTATATAAGAACGAAAATTGTCATCCTGCATTTTTTCTTTAAAACAGCTATACA
AAAAGTGATACCGACATACAATGAAGTATCTAAACTTAGTTTTCGTGCTTCAGCTTCTTA
TTAGCATCAAATACGCCTCATTCGGCCGAGCCTTTTCTCTTTTTGAAGATGATACCACCT
TTGCCAATTTGGATAAACAGCTAAAGCTTCCACAGAATACACAGCAAACCCTTAAATTGG
ACCGTTTGAATCACGATGATCCGCTGTTTACAACTTTTATTTCTTCTGTGGACACAGATT
ACAGTTTGAGACTTAGAACAGTAGATCCTTCTAAACTAGGAATTGACACCGTAAAACAAT
GGTCGGGTTACATGGACTATAAGGATTCCAAACACTTTTTTTACTGGTTTTTTGAAAGTA
GGAACGATCCTGCTAACGACCCAATTATTCTTTGGTTAAATGGTGGACCTGGTTGTTCCT
CGTTTACTGGGTTGCTATTTGAACTAGGCCCCTCATCAATTGGCGCCGATATGAAACCAA
TCCACAATCCCTATTCTTGGAATAATAACGCTTCAATGATCTTCTTAGAACAGCCACTCG
GAGTCGGCTTTTCCTATGGTGATGAAAAGTCTCCTCTACAAAATTAGCAGGCAAAGATG
CGTACATTTTCCTGGAATTGTTTTTTGAAGCTTTTCCTCATTTACGCTCCAACGATTTCC
ACATTGCAGGCGAATCCTATGCAGGACATTATATCCCTCAAATTGCACATGAGATCGTTG
TCAAGAACCCTGAAAGAACGTTCAATTTAACTTCAGTTATGATTGGTAATGGTATCACAG
ACCCTTTGATTCAAGCAGATTATTATGAACCAATGGCATGCGGGAAGGGGGCTATCACC
CTGTTCTCTCATCAGAAGAATGTGAGAAATGAGTAAAGCTGCAGGTCGTTGTCGTAGGT
TGAACAAGTTATGTTATGCTTCTAAATCAAGTTTACCATGCATAGTCGCCACTGCTTACT
GTGACTCTGCACTTTTGGAACCGTACATTAACACAGGACTCAACGTCTATGACATTAGAG
GGCCCTGTGAAGATAATAGTACTGATGGTATGTGTTATACAGGTCTCCGCTATGTCGACC
AGTATATGAATTTTCCTGAAGTTCAAGAAACGCTAGGGTCCGACGTGCATAATTATTCTG
GCTGTGATAATGACGTGTTCACCGGATTTTTGTTTACGGCGATGGAAGTAAACCATTTC
AACAATATATTGCTGAATTATTAAATCACAACATTCCGGTATTAATATATGCGGGTGATA
AGGATTATATTTGTAATTGGCTGGGAAACCATGCTTGGTCCAATGAGTTGGAATGGATCA
ATAAACGTAGGTATCAGAGAAGGATGTTAAGACCATGGGTCAGTAAAGAAACAGGTGAAG
AGTTGGGACAAGTCAAGAACTATGGCCCTTTCACCTTTTTGAGAATATACGATGCCGGTC
ATATGGTGCCCTATGATCAACCGGAGGCAAGTTTGGAAATGGTCAACAGTTGGATTTCCG
```

GTAATCGTGCTTTTTCGGATCTTTCCACCTTGGAAAATGCTAGTTAG

>YBR139W, 508 aa (SEQ ID NO 56)
MKYLNLVFVLQLLISIKYASFGRAFSLFEDDTTFANLDKQLKLPQNTQQTLKLDRLNHDD
PLFTTFISSVDTDYSLRLRTVDPSKLGIDTVKQWSGYMDYKDSKHFFYWFFESRNDPAND
PIILWLNGGPGCSSFTGLLFELGPSSIGADMKPIHNPYSWNNNASMIFLEQPLGVGFSYG
DEKVSSTKLAGKDAYIFLELFFEAFPHLRSNDFHIAGESYAGHYIPQIAHEIVVKNPERT
FNLTSVMIGNGITDPLIQADYYEPMACGKGGYHPVLSSEECEKMSKAAGRCRRLNKLCYA
SKSSLPCIVATAYCDSALLEPYINTGLNVYDIRGPCEDNSTDGMCYTGLRYVDQYMNFPE
VQETLGSDVHNYSGCDNDVFTGFLFTGDGSKPFQQYIAELLNHNIPVLIYAGDKDYICNW
LGNHAWSNELEWINKRRYQRRMLRPWVSKETGEELGQVKNYGPFTFLRIYDAGHMVPYDQ
PEASLEMVNSWISGNRAFSDLSTLENAS

>YCL052C, 1751 bp, CDS: 501-1751 (SEQ ID NO 67)
TGCACATGTTGAGTATGCGTATTGGGCATTTTCCTATTCTGAGAAGGAGTATGAAATAAT
TGCCGAGGGTTCAGAATGCTCTTTTAGAAATAAAAATGAATGTAAATAGTTGGAATGTAT
CTTTAAGTAGACAAATGCAGGTAAGTTTTAGTGGCCTTTGCGGATTAACAGTATGCTCTT
AGTGCAAAACACGAAAAGAGCTCCCAATCTTTGAACACAATCGACCACGGAGGAACAATA
CACGTAGAAGGGGATAACTAAAACTTTGTCGTGCAAGAGTATTGGAGGACACACTAACAG
CAGAACTTTGCCTTCTTAACTCTTGTTTATGATTGCTTGAAGTATTACACATGTAATAAA
AGATGATTATTTTTTTTTTCCTAAAAAAAGTTCCTTTCTTTGAAGATCCCCTGATAAAA
AAGATCAAATAATGGAAACGCTAATCATAATCAAATCGGGAGGAGAATAAACGCAAGAAG
TGTGCGTTTCTAGCTGAGTAATGGTGACAAGACATAGAGTGACTGTACTCTACAATGCCC
CTGAGGATATCGGTAATCATATGCGCCAAAATGACACTCATTTGACTGTTCGTGGAGGTT
CTGGTGTGGTTTTACAACAAAGGTGGCTATTAGAGAGGACTGGAAGCTTGGATAAATCCT
TTACGAGAATCACTTGGAGGCCCAGAGCGGACTTGGCTAGAAGTTTAAGCGTTATAGAAA
ATGAACTGAGTGCTGGCTTTTCAGTTTACTCAAATTCTTCGGATGTGCCGGAAAGGTTTA
TTACTAACCCAGTCTACAATTCATTTCACAGTGAGAAGTTTGACATAGAGCAGTACTTGC
CTCCCGAAGTAGATTTGAATCTGTCATGGAATCCAGAAGATTTTACATATGATATATCAG
TGGAGCCCACACAAATCCAAATTGTTGAATATCGTCTGTTGAAACAGGGTGAAGAATTTA
CAATTGCAAGAGTGAAAGATGAGAAACTCGAAGTAGGTGTATTCTTTGTGGATGCAAGTG
ATGAAAGTGATGTCGATATTGGTGGAATACGTTGTAATTGGAGGATGGACGATGGTAAAA
TGGAAAGATGTCAGAAAACATCCTTATTGTATAAACAGGGCCATATCGCATACAATCACT
CGACGACTACGACATCACTATATCTGAATGAACCTATCGGTTTGCATCCAAAAATCATGA
TTGATCTCACAGATTTCGAAGAACGCCCTAAATGCATGTATCTAATGCACCTGCAATTGC
CGTTAGAATTATTTATCGATAAATTCCAATCCTCTCCCTTACTACTTTTGGAGAAGACG
ACTTAGAATTACCAGAATACTCTCTTCGAGATAAGGCATGGGGTTCTGAAAGTATCTTTG
AATTGAAAGCCGGCACAATGAATGAAGTGACATTGCATACTAGATATATTGAGCCTTCTA
ATAATAAAGGGGATAAATTAGAAGTTTCATTTGATCCAGAAGTTATATTAGCCTGCGACA
CAGGTGACAATAAAGTTTCCCGTAATCCATTTTATAAAAAGGTCTAGGATATGAATCTC
TCTTTACAGACGATACTACATTCCGCCATTTGAACTCGACAACTCTTCTAGTACCAATTC
CAAGGCCTGACACAAAGGATTATTCCAAGATCAAAAATGGTACGTTACTATGCTTACTCA
TCTCCATCATATACATTTTCTCCAAGGTATTTGGTAACAACAAGAAGAAAAGATCAGTAA
AACGGGAATAA

>YCL052C, 416 aa (SEQ ID NO 68)
MVTRHRVTVLYNAPEDIGNHMRQNDTHLTVRGGSGVVLQQRWLLERTGSLDKSFTRITWR
PRADLARSLSVIENELSAGFSVYSNSSDVPERFITNPVYNSFHSEKFDIEQYLPPEVDLN
LSWNPEDFTYDISVEPTQIQIVEYRLLKQGEEFTIARVKDEKLEVGVFFVDASDESDVDI
GGIRCNWRMDDGKMERCQKTSLLYKQGHIAYNHSTTTTSLYLNEPIGLHPKIMIDLTDFE
ERPKCMYLMHLQLPLELFIDKFQSSPLLLFGEDDLELPEYSLRDKAWGSESIFELKAGTM
NEVTLHTRYIEPSNNKGDKLEVSFDPEVILACDTGDNKVSRNPFYKKGLGYESLFTDDTT
FRHLNSTTLLVPIPRPDTKDYSKIKNGTLLCLLISIIYIFSKVFGNNKKKRSVKRE

>YCR009C, 1298 bp, CDS: 501-1298 (SEQ ID NO 73)
GTACAAAAATGATTACGAAAATATAGATGATGTAAGCAAGGTACGGTTATAAACAGTTAA

CATATAAGTTTACTTCACTTTTTTGCTGACTCCTTTACTTGTCTTCCCTGCACTTTGATT
TTACTTCAGAAAAAATAAGATATATGTTTCTGATAAACTTTTAGGTTAGCGGAGAAGAT
GTTGCCACGAATATCATGTAATTGAAAGGCAACGAAAGGTCTATCGTTTGCCATTCATAA
TGTGATTCGACTTGTCTTTTTCATTGTAACAGACATGAAACGTTTCCTTTACGTCCCTAT
GAATTTTTGTTGGCTGAACTGGGCGCTGCAGGGGCTGGACGATCCAAATGCGCGGATTTT
GAACAATTATGAGAATCCGAATTAAAAGAAAGGGAAAACAAATTTAATAACAGGCAGACG
TGAGAGAAGAAAAGGAAACGCTGTGATATAGAAACTATACAAATCCTATTATAAGAAGC
CAGAAGAAAGCTGATACAAGATGAGTTGGGAAGGTTTTAAGAAAGCTATCAACAGAGCTG
GTCACAGTGTGATAATTAAGAATGTCGACAAGACCATTGATAAAGAGTATGACATGGAAG
AACGTCGTTATAAAGTTCTTCAAAGAGCAGGTGAGGCATTACAAAAGGAAGCCAAAGGTT
TCTTGGACTCATTGAGAGCTGTGACAGCATCACAGACTACCATTGCCGAGGTCATCTCTA
ACCTCTATGACGATTCAAAATATGTTGCTGGTGGTGGTTACAACGTTGGTAACTATTATT
TGCAATGTGTTCAAGATTTTGATAGCGAAACTGTTAAGCAATTAGACGGGCCCTTAAGAG
AAACCGTACTAGATCCAATAACAAAGTTTTCGACGTATTTCAAAGAAATTGAGGAGGCCA
TAAAAAAGAGAGACCATAAGAAACAAGACTTCGATGCTGCGAAGGCAAAAGTTCGTAGAT
TAGTGGACAAACCTGCTAAAGATGCCTCTAAACTGCCAAGGGCTGAAAAAGAATTGAGCT
TAGCTAAAGATATTTTCGAAAATCTTAATAACCAATTGAAAACTGAACTACCACAGTTAG
TTTCATTAAGAGTACCTTACTTTGACCCAAGTTTTGAAGCTTTAATCAAGATTCAGCTAA
GGTTCTGTACTGATGGTTACACTCGTTTAGCGCAGATTCAACAATATTTGGACCAACAAT
CAAGAGACGACTATGCCAATGGGTTATTAGACACTAAAATCGAAGAACTATTAGGACAAA
TGACAAGCCTAGATATTTGTGCGCTCGGGATAAAATAA

>YCR009C, 265 aa (SEQ ID NO 74)
MSWEGFKKAINRAGHSVIIKNVDKTIDKEYDMEERRYKVLQRAGEALQKEAKGFLDSLRA
VTASQTTIAEVISNLYDDSKYVAGGGYNVGNYYLQCVQDFDSETVKQLDGPLRETVLDPI
TKFSTYFKEIEEAIKKRDHKKQDFDAAKAKVRRLVDKPAKDASKLPRAEKELSLAKDIFE
NLNNQLKTELPQLVSLRVPYFDPSFEALIKIQLRFCTDGYTRLAQIQQYLDQQSRDDYAN
GLLDTKIEELLGQMTSLDICALGIK

>YCR010C, 1352 bp, CDS: 501-1352 (SEQ ID NO 75)
GAGCTCCGTGGAATAGGCGAGCGGCTGAGTGGTTCTCCAAGCTACGGTTTTTACGTGTAG
CCCCATGTGAGCAAGCCAAACAAGGGCCCTTAAAGGCGTGACTACAAAAAGGGGCGGGTT
GGAAGGTCATCTGCAGCGAGATACGAAAAGATTTTTTGCCAGATTTGCGGTTGGGCGGCT
ATTTCGGTATTGTTGGGGTAACAAACGTTGGGGAAGACTGCATTTTCTTACAGCTTTTTT
TCGTTATCGCGGGTTGGGCGGCTATGGCGCCTTCTCCTCTGTACTCCAACCTGTCAGAGA
CACCAAGCTGTATATAAAGCACCTTGGTTGGATCGTATTTCCCTGAGATCTTGCTATAGG
TTCATTTTATATATCGTCCAATAGCAATAACAATACAACAGAAACTACTAGCATCTGTTT
ATAAGAAAAGGCAAATAGTCGACAGCTAACACAGATATAACTAAACAACCACAAAACAA
CTCATATACAAACAAATAATATGTCTGACAAGGAACAAACGAGCGGAAACACAGATTTGG
AGAATGCACCAGCAGGATACTATAGTTCCCATGATAACGACGTTAATGGCGTTGCAGAAG
ATGAACGTCCATCTCATGATTCGTTGGGCAAGATTTACACTGGAGGTGATAACAATGAAT
ATATCTATATTGGGCGTCAAAAGTTTTTGAAGAGCGACTTATACCAAGCCTTTGGTGGTA
CCTTGAATCCAGGGTTAGCTCCTGCTCCAGTGCACAAATTTGCTAATCCTGCGCCCTTAG
GTCTTTCAGCCTTCGCGTTGACGACATTTGTGCTGTCCATGTTCAATGCGAGAGCGCAAG
GGATCACTGTTCCTAATGTTGTCGTCGGTTGTGCTATGTTTTATGGTGGTTTGGTGCAAT
TGATTGCTGGTATTTGGGAGATAGCTTTGGAAAATACTTTTGGTGGTACCGCATTATGTT
CTTACGGTGGGTTTTGGTTGAGTTTCGCTGCAATTTACATTCCTTGGTTTGGTATCTTGG
AAGCTTACGAAGACAATGAATCTGATTTGAATAATGCTTTAGGATTTTATTTGTTGGGGT
GGGCCATCTTTACGTTTGGTTTAACCGTTTGTACCATGAAATCCACTGTTATGTTCTTTT
TGTTGTTCTTCTTACTAGCATTAACTTTCCTACTGTTGTCTATTGGTCACTTTGCTAATA
GACTTGGTGTCACAAGAGCTGGTGGTGTCCTGGGAGTTGTTGTTGCTTTCATTGCTTGGT
ACAACGCATATGCAGGTGTTGCTACAAAGCAGAATTCATATGTACTGGCTCGTCCATTCC
CATTACCATCTACTGAAAGGGTAATCTTTTAA

>YCR010C, 283 aa (SEQ ID NO 76)
MSDKEQTSGNTDLENAPAGYYSSHDNDVNGVAEDERPSHDSLGKIYTGGDNNEYIYIGRQ

KFLKSDLYQAFGGTLNPGLAPAPVHKFANPAPLGLSAFALTTFVLSMFNARAQGITVPNV
VVGCAMFYGGLVQLIAGIWEIALENTFGGTALCSYGGFWLSFAAIYIPWFGILEAYEDNE
SDLNNALGFYLLGWAIFTFGLTVCTMKSTVMFFLLFFLLALTFLLLSIGHFANRLGVTRA
GGVLGVVVAFIAWYNAYAGVATKQNSYVLARPFPLPSTERVIF

>YCR021C, 1499 bp, CDS: 501-1499 (SEQ ID NO 79)
ATCGAAAGCGTGCTTTGTAAGAATATTTGGTATGGCTAAAGTAAGCAAAGCCATATCCCG
ATCCCGATCCCGACTCTTATTCCGATCCCTTCCGCCACATCCTGCATGTTTATTCGAATA
CCAAATTAGCTCATCTTCGTTATTTCATCATCCCTTTCTGCTATGGCAAGGACAAGTTTT
TTTCTAGCATCTCATCGAAAACTTTCCTCTCCCTAATTGGCCAAAGTTTTCATATTCATC
ATCAGTTAGAAAGTATAATATCAATCCCTTACCTCATTACAAGTTGTATCACACTAAAAA
AATCATATATAAGTCTGTGAGAGTCTTCAATTATTTAGCGTAACACCTATTCACTTTCTA
ATCTTGTTTCTTGTTTTTACATTCTGCAATACAACACAACAACAAATATTAACTCAATTA
TTATTATTTATAATTACAAAAACAAAACAACAAGTTTGAGACTTTAATATCTTTTGATTA
CTAAAAACAACAAATTTCAAATGAACGATACGCTATCAAGCTTTTTAAATCGTAACGAGG
CTTTAGGGCTTAATCCACCACATGGCCTGGATATGCACATTACCAAGAGAGGTTCGGATT
GGTTATGGGCAGTGTTTGCAGTCTTTGGCTTTATATTGCTATGCTATGTTGTGATGTTCT
TCATTGCGGAGAACAAGGGCTCCAGATTGACTAGATATGCCTTAGCTCCTGCATTTTTGA
TCACTTTCTTTGAATTTTTTGCTTTCTTCACTTATGCTTCTGATTTAGGTTGGACTGGTG
TTCAAGCTGAATTTAACCACGTCAAGGTTAGCAAGTCTATCACAGGTGAAGTTCCCGGTA
TTAGACAAATCTTTTACTCGAAATATATTGCCTGGTTCTTGTCCTGGCCATGCCTTTTAT
TTTTAATCGAGTTAGCCGCTAGTACTACTGGTGAGAATGACGACATTTCCGCCTTGGATA
TGGTACATTCGCTGTTAATTCAAATCGTGGGTACCTTATTCTGGGTTGTTTCGCTATTAG
TTGGTTCATTGATCAAGTCCACCTACAAGTGGGGTTATTACACCATTGGTGCTGTCGCTA
TGTTGGTTACCCAAGGTGTGATATGCCAACGTCAATTCTTCAATTTGAAAACTAGAGGGT
TCAATGCACTTATGCTGTGTACCTGCATGGTAATCGTTTGGTTGTACTTTATCTGTTGGG
GTCTAAGTGATGGTGGTAACCGTATTCAACCAGACGGTGAGGCTATCTTTTATGGTGTTT
TGGATTTATGTGTATTTGCCATTTATCCATGTTACTTGCTAATTGCAGTCAGCCGTGATG
GCAAATTGCCAAGGCTATCTTTGACAGGAGGATTCTCTCATCACCATGCTACGGACGATG
TGGAAGATGCGGCTCCTGAAACAAAAGAAGCTGTTCCAGAGAGCCCAAGAGCATCTGGAG
AGACTGCAATCCACGAACCCGAACCTGAAGCAGAGCAAGCTGTCGAAGATACTGCTTAG

>YCR021C, 332 aa (SEQ ID NO 80)
MNDTLSSFLNRNEALGLNPPHGLDMHITKRGSDWLWAVFAVFGFILLCYVVMFFIAENKG
SRLTRYALAPAFLITFFEFFAFFTYASDLGWTGVQAEFNHVKVSKSITGEVPGIRQIFYS
KYIAWFLSWPCLLFLIELAASTTGENDDISALDMVHSLLIQIVGTLFWVVSLLVGSLIKS
TYKWGYYTIGAVAMLVTQGVICQRQFFNLKTRGFNALMLCTCMVIVWLYFICWGLSDGGN
RIQPDGEAIFYGVLDLCVFAIYPCYLLIAVSRDGKLPRLSLTGGFSHHHATDDVEDAAPE
TKEAVPESPRASGETAIHEPEPEAEQAVEDTA

>YDR073W, 1010 bp, CDS: 501-1010 (SEQ ID NO 91)
GTTAGCTTGCCTTGCATTTCCCCATGCGTCTCGAATAGGAATTATTCAAGATGGATTATT
GGCATTTACGAGTAACCAAGGATAACCCCGCTGTGCGTGAAACCACCCTCTTTTCACGTT
TCTTCAAGGCCAGTGCAAACGCGAATAAACATATCTACGCTATATATAGATATGACGTTT
CTCAAGCCAACAGAAGTAGATAAAGCAGCCAGGAGGGTAGAGAGTGTTCAAATTATAGCA
AGCCTTCTTCTACCTGTTTTTTTTGATGATTGTTTTGCCGGGTAACAATCGACTTTCGG
GCAAATTTTTTTTCCTTTTTTCTCCTAACAGTATATACGGAGTGGAGAACAGACTTCCCA
TAAAAGCATATTACGTGGGTCGTAGTAAGATTGCCGTTTATGATACCCTCTATTCAGGG
CTCAGAGCGCATCACGATCGGGAGTGTAAATTCAATGTGCATATAAGCAAAACACACAGA
TTTCCTTTTTTCCCAGAAAAATGAGCAGTGAAATTGCCTACTCGAATACGAACACCAACA
CTGAAAACGAGAACCGCAATACTGGCGCTGGCGTAGATGTAAATACAAATGCAAATGCAA
ATGCAAATGCAACTGCAAATGCAACTGCAAATGCAACTGCAAATGCAACTGCAGAGCTGA
ACCTCCCCACGGTCGATGAGCAAAGACAGTATAAGGTACAACTGCTATTGCATATCAACA
GCATATTACTTGCTAGAGTTATTCAGATGAATAATAGTTTACAAAACAATCTACAGAACA
ATATAAATAATAGCAATAACAATAACATCATCAGGATACAGCAACTTATATCTCAGTTCC
TTAAAAGGGTTCATGCCAATCTTCAATGCATATCTCAGATAAACCAAGGAGTGCCCTCAG

CGAAACCACTGATCCTCACGCCTCCTCAGCTAGCCAACCAGCAGCAACCTCCACAGGATA
TTCTTTCTAAACTCTATCTTCTCTTGGCAAGAGTGTTCGAGATATGGTAG

>YDR073W, 169 aa (SEQ ID NO 92)
MSSEIAYSNTNTNTENENRNTGAGVDVNTNANANANATANATANATANATAELNLPTVDE
QRQYKVQLLLHINSILLARVIQMNNSLQNNLQNNINNSNNNNIIRIQQLISQFLKRVHAN
LQCISQINQGVPSAKPLILTPPQLANQQQPPQDILSKLYLLLARVFEIW

>YDR178W, 1046 bp, CDS: 501-1046 (SEQ ID NO 105)
ACGATTAGGCGTCAAGTCCTTAGACCCCAATGACAACAACACAGCCAACCGTATCATCGA
GGAATTGTTGAAGTGAATAGATAAAAAAAAAACGCACCAAGTAAGTAAGTAAATAAAGAA
TAAATAAACTATATGAGTAAAACACCAAGCGAGGATGTTTCATTGTGCATCCGTGTTCTT
GATGATCACATAACTGTAAAAGAATAATACGGCACGTTAAATGTTATTTTAGAATATATA
AACACCTTATGTGCCATAAGCATTGAGCCAATCGCTGCTGTTTTTTTTATTCCGGGGCAC
CTTCGGAAGAACACAGGCGCAATTTAGTTATATAAGGAGAAGCCCTCGAGCGATCAGGGG
ACCGACTGCGGATCGCTTTAAGGCAAAGATAGAAGGATAAATATCTGCTTTGGAAGATAG
TCGTATCTAATTTCCCATTCTGTTGTTTTCTTGATCTTTCCTACGCTTTCGACTTTCTTC
CTACGCGCTTTATAATAGCTATGATGTTGCCAAGATCCATGAAATTTATGACTGGAAGGA
GAATTTTCCATACTGCCACAGTAAGGGCCTTCCAGTCTACCGCTAAGAAGAGCTTAACTA
TCCCATTTTTGCCCGTATTACCCCAGAAACCAGGTGGTGTTAGGGGCACTCCCAATGATG
CCTACGTCCCCCCCCCTGAGAATAAATTAGAGGGCTCATACCACTGGTATATGGAAAAAA
TCTTTGCCTTGTCCGTCGTTCCATTGGCTACGACGGCTATGCTGACAACCGGTCCGTTAT
CCACTGCAGCTGATTCTTTCTTTTCTGTCATGCTTTTGGGATATTGTTACATGGAATTTA
ACTCTTGTATCACCGATTATATTTCTGAAAGAGTTTATGGTGTTTGGCACAAGTACGCCA
TGTATATGTTGGGCCTTGGTTCTGCGGTCTCCCTTTTTGGAATCTATAAACTAGAAACCG
AGAATGATGGTGTTGTTGGTTTAGTAAAAAGTCTATGGATTCTTCCGAGAAAGACAACA
GTCAAAAGATTGAAGCCAAGAAGTAG

>YDR178W, 181 aa (SEQ ID NO 106)
MMLPRSMKFMTGRRIFHTATVRAFQSTAKKSLTIPFLPVLPQKPGGVRGTPNDAYVPPPE
NKLEGSYHWYMEKIFALSVVPLATTAMLTTGPLSTAADSFFSVMLLGYCYMEFNSCITDY
ISERVYGVWHKYAMYMLGLGSAVSLFGIYKLETENDGVVGLVKSLWDSSEKDNSQKIEAK
K

>YDR202C, 1556 bp, CDS: 501-1556 (SEQ ID NO 107)
GAATTCCAACCGGAAATTGCAAACAGCAGCAATTTCTCGTACCGATGAAGGGGAACATGG
CCGTTGTACCGAGGTTCCATTGGCCGAGTATTAGCCAGGGCCCTAATACGTAACTCGGTA
CGCTCTTCAGCTTCTTTCGCATAATCAACGTTCTTGTTATGTAACTCACCACGTTCCATG
GCATCCGCCAACCTTGCTTCCTTACCAAATATTAATGAGCCTAAGGTGTACATTGCCGCC
GCAGGTAATATTAGCCCACGACGTTGGCATTTCACTGGCAAAGTAGCTGTTGATCTCAGT
AAAGATAACCTCAACATACTCTTTTACTTGTCCTTTTTTGTAGCTAATTGCTTTCCTCCC
CTTCTTTTCCACAAACCGCAACTATTTTTCTCTCAAAAGTTATATGAAGTATATACTG
AATGGAGCAATTCGGGGTTGAGTGAATTACAAAATTATAGTATCTGATCAAGCACACAGT
GGAAGTGCTCGAAAAGCAATATGAGTGTTGATTTGTTTCCAAATGATAGATTTGGTGCAG
AAGATAAATACGACAACTTTAAGGATGCCGTAAAAGAATGCTCCTGGCTCATCGAAGAAA
TCGTCAAACCGCAATTACCCAACATTATTGACAACTTTTCTAAATGCCTAGAGATGCTAG
AGAGTGACCAAATATTCAAAATGCCTGTATCTAATGGTATTCCCAACGAAAGTAACAAAC
AAAACGACTCTCCGACGGTAAAGGGTGTTATCACAAGACAAGGCCAATACATTGTTGACT
TTCACATTGTTGTCAGATTCCCACAATTTCAAAGGGGTAAACAAGTTATGTTCCGAATGA
ATACGGGACTGAATTTCTTACTTATTCAATTCAGTAAGATAATGACGCACTTGAAAAATA
TTTTGGAAATACTGAATCAACTTCAAGTAGCTACAGATGTCAGCGAATTCGTATCCAAAT
TTGGCGTGGCCATGGAACTTTTGAACCATTCTCTAATACTTTTACAAAATCCTCCTAGAG
ACCTGGTATTCCCAGAAGATAACAACTTTGCTATGAAGGAAATGTTCCAGGATTGTTACT
CAGTCTGCGAATCCACAGCTCACATCCTAGGACTGGAACTTACGCTTTGTAGGAATGAGC
TTTGCATAGAACTACGAAATCTAATTAAGGTGACTAAAAAACCTTGGTGCGAGATTGATA
GTAAAACTGGCAGGTCATTTTGCGACCAAATAAGAAATCAAGTGACAAATGAAAGAAACA

AAACTTTATCTAAGATCCTCTCAGAAAACGGTGTACAAGTCCAGGATTCCACATTACTTA
ACCACATAATTTCTTCTTTTCAAAGTGAAGCTATAACACTTCCAGAAGCTCAGGAATTAT
TAAGAAGGGGCGTTACTTTCGATAATAGGGTAGTCATGGAATGTGAAAAGTTAATAGTAT
CTACAAGTGATCCAACTTTGATCAGTATAAGCGCCAAATTGAACAGTCTCAAAGCTTCGA
TGGCGAACCATCAAGCAAATTTGGTAGCTAGCAAACAGTTAAGTACATATAAGTAA

>YDR202C, 351 aa (SEQ ID NO 108)
MSVDLFPNDRFGAEDKYDNFKDAVKECSWLIEEIVKPQLPNIIDNFSKCLEMLESDQIFK
MPVSNGIPNESNKQNDSPTVKGVITRQGQYIVDFHIVVRFPQFQRGKQVMFRMNTGLNFL
LIQFSKIMTHLKNILEILNQLQVATDVSEFVSKFGVAMELLNHSLILLQNPPRDLVFPED
NNFAMKEMFQDCYSVCESTAHILGLELTLCRNELCIELRNLIKVTKKPWCEIDSKTGRSF
CDQIRNQVTNERNKTLSKILSENGVQVQDSTLLNHIISSFQSEAITLPEAQELLRRGVTF
DNRVVMECEKLIVSTSDPTLISISAKLNSLKASMANHQANLVASKQLSTYK

>YDR256C, 2048 bp, CDS: 501-2048 (SEQ ID NO 115)
GGGAAGAACTAAGAGATGTTATGGCTCGGAGAGTTTTGAAAAGCGAAATAGATTCGCTGC
AAGTTTGTGAAGAAACCATCGACAAGAATTACAAGGTTATTCCTGATGAAAAGCTGCTAA
CTAATATTTTAAAGAGAAAGTTGACAGAGGAAGAAAAAAGCTCTGTCAAACGTCCTTGCG
TGAAGAAGTGAGCGGTTGTTCTAACCACTATTTAAAGCCGCAATTAGTAATGCAAAAAGT
TGGCCGGAATTAGCCGCGCAAGTTGGTGGGGTCCCTTAATCCGAAAAAGGACGGCTTTAA
CAAATATAAACTCCGAAAATCCCCACAGTGACAGAATTGGAGAAACAACCAGTTTTGATA
TCGCCATACATATAAAGAGATGTAGAAAGCATTCTTCACTGTAATGTCCAAATCGTACAT
TTGAATTTCTTGTAGGTTTATTTAAAAGGTAAGTTAAATAAATATAATAGTACTTACAAA
TAAATTTGGAACCCTAGAAGATGTCGAAATTGGGACAAGAAAAAAATGAAGTAAATTACT
CTGATGTAAGAGAGGATAGAGTTGTGACAAACTCCACTGGTAATCCAATCAATGAACCAT
TTGTCACCCAACGTATTGGGGAACATGGCCCTTTGCTTTTGCAAGATTATAACTTAATTG
ATTCTTTGGCTCATTTCAACAGGGAAAATATTCCTCAAAGGAATCCACATGCTCATGGTT
CTGGTGCCTTCGGCTATTTTGAAGTAACCGATGACATTACTGATATCTGCGGGTCTGCTA
TGTTTAGTAAAATTGGGAAAAGAACGAAATGTCTAACAAGATTTTCGACTGTGGGTGGTG
ATAAAGGTAGTGCCGACACGGTTCGTGATCCAAGGGGGTTTGCCACCAAATTCTACACTG
AAGAAGGTAATTTAGATTGGGTCTACAATAATACACCGGTATTCTTTATCAGAGACCCTT
CCAAGTTCCCTCACTTTATCCACACACAGAAGAGAAACCCACAAACCAACCTAAGGGATG
CTGACATGTTTTGGGATTTCCTCACCACTCCTGAAAATCAGGTGGCCATTCATCAAGTAA
TGATCCTTTTTTCAGACCGTGGTACCCCTGCCAACTACCGTAGTATGCATGGTTATTCTG
GTCATACCTATAAATGGTCCAATAAAAACGGAGATTGGCATTATGTGCAAGTTCATATCA
AAACCGATCAAGGAATAAAGAATTTGACCATAGAAGAGGCTACCAAAATTGCGGGATCCA
ATCCAGATTACTGCCAGCAGGATTTATTTGAGGCTATTCAGAATGGAAACTATCCTTCCT
GGACAGTTTATATTCAAACAATGACCGAACGCGATGCCAAAAAATTACCATTTTCAGTCT
TTGATTTGACTAAAGTATGGCCTCAGGGGCAATTCCCTTTACGGCGTGTGGGTAAGATTG
TTTTGAACGAGAATCCACTGAACTTCTTCGCACAGGTGGAACAAGCTGCCTTCGCCCCCA
GTACCACGGTTCCTTACCAAGAAGCAAGCGCTGATCCAGTATTACAGGCCCGTTTGTTTT
CATATGCGGATGCTCATAGATACAGGCTAGGTCCTAACTTCCATCAAATACCCGTAAACT
GTCCATATGCATCTAAATTTTTCAATCCCGCTATCAGAGATGGACCGATGAATGTTAACG
GCAACTTCGGCTCAGAACCTACATATTTGGCCAACGATAAATCGTACACGTATATCCAAC
AGGACAGACCCATTCAACAACACCAAGAGGTATGGAATGGGCCAGCTATCCCTTATCATT
GGGCAACATCCCCAGGTGATGTAGATTTCGTGCAAGCAAGAAATCTCTACCGCGTTTGG
GTAAACAACCTGGACAGCAAAAGAACTTGGCATATAACATCGGCATTCATGTAGAAGGCG
CCTGTCCTCAAATACAGCAGCGCGTTTATGATATGTTTGCTCGTGTTGATAAGGGACTAT
CTGAGGCAATTAAAAAAGTAGCTGAGGCAAAACATGCTTCTGAGCTTTCGAGTAACTCCA
AATTTTGA

>YDR256C, 515 aa (SEQ ID NO 116)
MSKLGQEKNEVNYSDVREDRVVTNSTGNPINEPFVTQRIGEHGPLLLQDYNLIDSLAHFN
RENIPQRNPHAHGSGAFGYFEVTDDITDICGSAMFSKIGKRTKCLTRFSTVGGDKGSADT
VRDPRGFATKFYTEEGNLDWVYNNTPVFFIRDPSKFPHFIHTQKRNPQTNLRDADMFWDF
LTTPENQVAIHQVMILFSDRGTPANYRSMHGYSGHTYKWSNKNGDWHYVQVHIKTDQGIK

NLTIEEATKIAGSNPDYCQQDLFEAIQNGNYPSWTVYIQTMTERDAKKLPFSVFDLTKVW
PQGQFPLRRVGKIVLNENPLNFFAQVEQAAFAPSTTVPYQEASADPVLQARLFSYADAHR
YRLGPNFHQIPVNCPYASKFFNPAIRDGPMNVNGNFGSEPTYLANDKSYTYIQQDRPIQQ
HQEVWNGPAIPYHWATSPGDVDFVQARNLYRVLGKQPGQQKNLAYNIGIHVEGACPQIQQ
RVYDMFARVDKGLSEAIKKVAEAKHASELSSNSKF

>YER103W, 2429 bp, CDS: 501-2429 (SEQ ID NO 145)
ACTATTGTCACTTCTCCATTGAGATTCGAAAAACCCCTCGGGTCTTGTTAGAACTAAATT
ACGTTCATAGGGGTGGGATTTATATTGTAATTCCGCGAGGTTTACACGAAAGATATCTCA
ACTCTAGCCGCACATCCATTCCGGTATGTACTCTCCCACCATTGGGTATTATAGAATGTA
ATAGGTTTCAAAGCGGATATCTTTTGCCCGGTGAGTTGTTACTTTTTCATTCGAGCAATG
AAGTACATTCTAGAAGTTCCTAGAACCTTATGGAAGCACCAAGAAAAAGGAAGTTAAAC
AAAACACTGATTCAATAAGCAAGGGGGAAGCTCCTTAGTTTGACGACAGTAACAAAATG
TTCGTATAAATTGAACGAAACTCAAGCCAATAAAGGACTTTTCAGAGGCCTATCTCTTCT
TTCTCCACAACTTTCGAATAAAAACCACTAATAAAAGTAAATAACAAAAACAAGAAAAA
AAATAAACAAAACAATAATCATGTCAAAAGCTGTTGGTATTGATTTAGGTACAACCTATT
CATGTGTTGCTCATTTTGCAAACGATAGGGTTGAAATTATCGCTAACGATCAAGGTAATA
GAACGACGCCTTCTTATGTGGCTTTTACTGACACAGAAAGGCTAATTGGTGACGCTGCGA
AGAATCAAGCTGCGATGAACCCACATAATACAGTATTCGATGCTAAGCGTCTGATCGGAC
GTAAATTCGATGATCCAGAAGTGACGAACGATGCTAAGCATTACCCATTCAAAGTGATTG
ACAAGGGAGGTAAACCGGTAGTGCAAGTGGAATATAAAGGCGAGACAAAGACATTTACTC
CAGAAGAAATTTCCTCAATGATCTTGACAAAGATGAAGGAGACTGCTGAGAACTTTTTAG
GAACAGAAGTGAAAGATGCTGTAGTAACGGTTCCAGCCTATTTCAACGATTCACAAAGGC
AAGCAACAAAAGATGCCGGTACAATCGCGGGCTTGAACGTTCTTCGTATCATTAATGAAC
CTACAGCTGCCGCTATTGCGTATGGGCTGGACAAGAAATCGCAGAAGGAGCACAACGTCT
TGATCTTTGATTTAGGTGGTGGTACTTTTGATGTCTCTCTGCTATCCATAGATGAAGGTG
TCTTTGAGGTTAAGGCTACTGCTGGTGACACTCACTTGGGTGGTGAAGATTTCGATAGTA
GGCTGGTTAACTTTCTAGCCGAGGAGTTCAAAAGAAAAAATAAAAAGGATCTAACAACTA
ACCAAAGGTCCCTAAGGAGGTTAAGGACCGCCGCTGAAAGGGCCAAGAGAACTCTGTCTT
CGTCTGCTCAGACATCTATAGAAATAGATTCATTATTTGAGGGTATCGATTTCTATACTT
CCATTACAAGGGCAAGATTTGAAGAATTATGTGCTGATTTGTTTAGATCTACATTGGAGC
CAGTGGAAAAAGTTTTGGCTGATTCAAAATTAGATAAGTCACAAATTGATGAAATTGTAC
TTGTTGGTGGTTCAACAAGAATTCCAAAAGTACAAAAACTGGTTTCTGATTTTTTCAATG
GTAAAGAACCAAACCGTTCGATTAACCCTGATGAGGCCGTCGCTTATGGTGCTGCCGTAC
AGGCTGCCATCTTAACGGGTGACCAGTCGTCGACGACCCAAGATTTACTGTTGCTGGATG
TTGCACCATTATCTCTAGGTATTGAAACTGCAGGTGGTATTATGACAAAGTTGATCCCAA
GAAATTCGACTATCCCAACAAAAAAATCGGAAGTGTTTTCCACCTACGCTGACAACCAAC
CTGGTGTGTTGATACAAGTTTTTGAGGGTGAAAGGACAAGGACAAAGACAACAATCTAC
TGGGTAAATTTGAGTTGAGCGGTATTCCACCCGCTCCAAGAGGCGTACCACAAATTGAAG
TTACATTTGATATCGATGCAAATGGTATTCTGAACGTATCTGCCGTTGAAAAAGGTACTG
GTAAATCTAACAAGATTACAATTACTAACGATAAGGGAAGATTATCGAAGGAAGATATCG
ATAAAATGGTTGCTGAGGCAGAAAAGTTCAAGGCCGAAGATGAACAAGAAGCTCAACGTG
TTCAAGCTAAGAATCAGCTAGAATCGTACGCGTTTACTTTGAAAAATTCTGTGAGCGAAA
ATAACTTCAAGGAGAAGGTGGGTGAAGAGGATGCCAGGAAATTGGAAGCCGCCGCCCAAG
ATGCTATAAATTGGTTAGATGCTTCGCAAGCGGCCTCCACCGAGGAATACAAGGAAAGGC
AAAAGGAACTAGAAGGTGTTGCAAACCCCATTATGAGTAAATTTTACGGAGCTGCAGGTG
GTGCCCCAGGAGCAGGCCCAGTTCCGGGTGCTGGAGCAGGCCCCACTGGAGCACCAGACA
ACGGCCCAACGGTTGAAGAGGTTGATTAG

>YER103W, 642 aa (SEQ ID NO 146)
MSKAVGIDLGTTYSCVAHFANDRVEIIANDQGNRTTPSYVAFTDTERLIGDAAKNQAAMN
PHNTVFDAKRLIGRKFDDPEVTNDAKHYPFKVIDKGGKPVVQVEYKGETKTFTPEEISSM
ILTKMKETAENFLGTEVKDAVVTVPAYFNDSQRQATKDAGTIAGLNVLRIINEPTAAAIA
YGLDKKSQKEHNVLIFDLGGGTFDVSLLSIDEGVFEVKATAGDTHLGGEDFDSRLVNFLA
EEFKRKNKKDLTTNQRSLRRLRTAAERAKRTLSSSAQTSIEIDSLFEGIDFYTSITRARF
EELCADLFRSTLEPVEKVLADSKLDKSQIDEIVLVGGSTRIPKVQKLVSDFFNGKEPNRS

INPDEAVAYGAAVQAAILTGDQSSTTQDLLLLDVAPLSLGIETAGGIMTKLIPRNSTIPT
KKSEVFSTYADNQPGVLIQVFEGERTRTKDNNLLGKFELSGIPPAPRGVPQIEVTFDIDA
NGILNVSAVEKGTGKSNKITITNDKGRLSKEDIDKMVAEAEKFKAEDEQEAQRVQAKNQL
ESYAFTLKNSVSENNFKEKVGEEDARKLEAAAQDAINWLDASQAASTEEYKERQKELEGV
ANPIMSKFYGAAGGAPGAGPVPGAGAGPTGAPDNGPTVEEVD

>YER150W, 947 bp, CDS: 501-947 (SEQ ID NO 149)
ATACGGGGGAAGAAGAAATATCATATTCAAAGCTAATTCATTGAAATTAGTGCTTGTCTC
ATCTAGCCTTTAGTGCTTAATCTCTGGAGGAGCACATATGGGGTTAAAGCCATGCCGGGA
CTGGGGGCCCCTATCGGGGCTCGAACCCGAATCCCGCGAGTATTTATTTGAAGGTCCGGG
ACGCAAGTTACCTAATCTGGTTAATTGATATCCCATTTAGGCGATGACGTTCCTTCCCCT
CACCCCTCGGCTTGTTAGAAGATCTATTGTTATAGCCTCCTCTGGAAGAATTTATGCCAG
ATGAAGAAAAAAACTTCTCGAAGTTCCCAGATGCCCAAATGAGGGCTTTCCATCCCTGTT
AGCTGGAAAAGTGTAAGTATATCTATATAAAAAGTCGGCCTACTTTTGCCAGGTTCGTCT
TTCACTTGCACTCTCTTGATCTTACTTTCTACTCAAAAAGAATCCAATACACAAAAATAA
AATCAGTACTATTACTAATAATGTTGTCTAACGCTAAGCTCCTTCTATCATTGGCCATGG
CCTCTACGGCTCTCGGATTGGTATCTAATTCTAGTTCCTCTGTAATCGTGGTACCATCAA
GCGATGCTACTATTGCCGGTAACGATACAGCCACGCCAGCACCAGAGCCATCATCCGCCG
CTCCAATATTCTACAACTCGACTGCTACTGCAACACAGTACGAAGTTGTCAGTGAATTCA
CTACTTACTGCCCAGAACCAACGACTTTCGTAACGAATGGCGCTACATTCACTGTTACTG
CCCCAACTACGTTAACAATTACCAACTGTCCTTGCACTATCGAGAAGCCTACTTCAGAAA
CATCGGTTTCTTCTACACATGATGTGGAGACAAATTCTAATGCTGCTAACGCAAGAGCAA
TCCCAGGAGCCCTAGGTTTGGCTGGTGCAGTTATGATGCTTTTATGA

>YER150W, 148 aa (SEQ ID NO 150)
MLSNAKLLLSLAMASTALGLVSNSSSSVIVVPSSDATIAGNDTATPAPEPSSAAPIFYNS
TATATQYEVVSEFTTYCPEPTTFVTNGATFTVTAPTTLTITNCPCTIEKPTSETSVSSTH
DVETNSNAANARAIPGALGLAGAVMMLL

>YFR033C, 944 bp, CDS: 501-944 (SEQ ID NO 155)
ATCGAGCCATTCGCGGTCGCTGAGTAAGCGACGGTCATCGGGCGCGCTCGTGGACGATGA
CAAGCGCGAATCACACAAGCATGCAGAGCAAGCACGGCGTAATCGATTAGCGGTCGCGCT
GCACGAACTGGCGTCTTTAATCCCCGCGGAGTGGAAACAGCAAAATGTGTCGGCCGCGCC
GTCCAAAGCGACCACCGTGGAGGCGGCCTGCCGGTACATCCGTCACCTACAGCAGAACGT
GAGCACGTGACCGTGCACCAATGGGAAGCACGTTCCGGGCATATCGGACTGGGGCGCGCC
TCCCCTGCGCGGTGCTTGTTATAAGAGGCGCTTTGCTGGAAAGTGGCCCACACCGGGTTT
TCGAGATTAGGACCTACTCAGTCTTAAGGGCAGTATTGGTTGGCGCTTATTTGCACATAT
TGTATACACGCACTCACATTAACAGAAGCACACATATACACTTACACCTACACACACGGA
TAAAGAAAAGAAATAGAAAATGGGCATGTTGGAACTAGTTGGTGAGTACTGGGAACAAC
TAAAGATAACCGTTGTGCCTGTTGTGGCCGCGGCCGAAGATGACGATAACGAGCAGCATG
AAGAAAAGGCAGCAGAAGGAGAAGAAAAGAAGAAGAAAATGGGGATGAAGATGAGGATG
AAGACGAAGACGAAGATGATGATGATGATGACGACGAAGATGAGGAAGAAGAGGAAGAAG
TCACTGATCAGTTGGAAGATTTGAGAGAACATTTCAAGAACACGGAGGAGGGTAAGGCCC
TTGTGCACCACTACGAGGAGTGTGCTGAGAGAGTCAAGATACAGCAACAACAACCCGGCT
ACGCGGATCTTGAACACAAGGAGGACTGTGTGGAGGAGTTTTTCCATCTACAGCACTATT
TGGACACTGCCACGGCACCTAGATTATTTGACAAATTAAAGTAG

>YFR033C, 147 aa (SEQ ID NO 156)
MGMLELVGEYWEQLKITVVPVVAAAEDDDNEQHEEKAAEGEEKEEENGDEDEDEDEDEDD
DDDDDEDEEEEEVTDQLEDLREHFKNTEEGKALVHHYEECAERVKIQQQQPGYADLEHK
EDCVEEFFHLQHYLDTATAPRLFDKLK

>YGR086C, 1520 bp, CDS: 501-1520 (SEQ ID NO 175)
GTTGAATATTTACCAATTGGGAAAAAGAACTCGTATTTCATTCCCCTTTTTGGAAAGGGG
TGGGGAGAGACTGTTGTTCAGCCACGTCAATTATTATTTTTTCTTTGGCCCTGCGCTTGT
CTTATAAAATTCCGCAGCCGCCTCTTATTTTTTTTTTTTCGATTTTTGGCCCACAGGTC

ATATTGCAAAAACCGAATGGCCGCGCCCCCTCACGCACGGGACGGAAGAAGGGCGGCGT
CCCCTGTTTTTCTGCTTTGGCTCATCTCTTTGGCTCCGACGGACGAAAGACGGGATTCCC
CCTCCCGTGTCTTTTTATAAATAACAAGTGCTCATTCTGCATCCTTCCTTGTTTCCCGTC
GTTTGGGTACAATGCGTTGATTATCCCAACCCAAGAAAGAAAATTTGTCTCACATCTGCA
TCTGCACATTTATTTACCTATACTTTTCCATTGTTAGCAGTATTGCAAAGTGAAGAATAT
ATCAGCATCAAGTATATAGTATGCACAGAACTTACTCTTTAAGAAATTCCAGGGCACCTA
CCGCCTCTCAATTACAGAACCCACCGCCACCACCATCTACAACCAAAGGTAGATTCTTTG
GGAAGGGTGGTCTAGCTTACAGCTTTAGGAGAAGTGCTGCTGGAGCTTTTGGCCCAGAAT
TATCCAGAAAGTTGTCTCAATTGGTTAAGATTGAAAAGAATGTTTTGAGGTCCATGGAAT
TGACAGCCAACGAAAGACGTGACGCTGCTAAGCAATTGTCTATTTGGGGGTTGGAAAACG
ATGACGATGTTTCCGACATCACTGATAAATTAGGTGTCTTGATCTATGAAGTTAGTGAAT
TAGACGACCAATTTATCGATCGTTATGACCAATACAGATTGACTCTAAAGTCCATCAGAG
ATATCGAAGGTTCTGTTCAACCATCTAGAGACCGTAAGGACAAGATCACCGACAAAATCG
CCTACTTGAAATACAAGATCCTCAATCACCTAAGATTGAGGTCTTGGAACAAGAATTGG
TGCGTGCTGAGGCTGAATCTTTGGTCGCTGAAGCTCAATTATCTAATATCACAAGGTCAA
AGTTGAGAGCTGCTTTCAACTACCAATTTGACTCCATCATCGAACATTCAGAGAAAATTG
CTTTAATCGCTGGTTACGGTAAGGCTCTCTTGGAACTATTGGACGACTCTCCTGTCACTC
CAGGTGAAACCAGGCCTGCTTACGATGGGTATGAAGCCTCTAAACAAATCATTATTGATG
CTGAAAGCGCACTGAATGAATGGACACTAGACTCTGCCCAAGTCAAGCCTACTTTAAGTT
TCAAGCAGGATTACGAAGACTTCGAACCTGAAGAAGGCGAAGAAGAGGAAGAGGAAGACG
GTCAAGGCAGGTGGTCCGAAGACGAACAAGAAGATGGACAAATTGAAGAACCTGAACAAG
AAGAAGAAGGTGCTGTTGAAGAACATGAACAAGTCGGACACCAGCAAAGTGAGTCTCTTC
CCCAACAAACAACAGCTTAA

>YGR086C, 339 aa (SEQ ID NO 176)
MHRTYSLRNSRAPTASQLQNPPPPPSTTKGRFFGKGGLAYSFRRSAAGAFGPELSRKLSQ
LVKIEKNVLRSMELTANERRDAAKQLSIWGLENDDDVSDITDKLGVLIYEVSELDDQFID
RYDQYRLTLKSIRDIEGSVQPSRDRKDKITDKIAYLKYKDPQSPKIEVLEQELVRAEAES
LVAEAQLSNITRSKLRAAFNYQFDSIIEHSEKIALIAGYGKALLELLDDSPVTPGETRPA
YDGYEASKQIIIDAESALNEWTLDSAQVKPTLSFKQDYEDFEPEEGEEEEEDGQGRWSE
DEQEDGQIEEPEQEEEGAVEEHEQVGHQQSESLPQQTTA

>YGR197C, 2144 bp, CDS: 501-2144 (SEQ ID NO 185)
TCCAGTATGCCACACATTATGCCTTGCACACCTAAAGCACATATTTTCGTTATTTTTCAC
CACAATAGGTGGATCTCGAAAAGGATGGAAAATCAGGAAAAAGAAATGTTGAGAAAAAAA
TAAACCGATTCCCGTTTAGTTTTCTCCTATTTCCGTGTATATGCGTGGTTATTCGTTTTC
GAATCCTTTTATGAATGTCCGAGGAGGTGGTACAATCCGAAATAGACTAAAGAAAAGCGA
AAGCCGTGAGTTTGTTTGATGATAGATGACTCGCAGCTTTGTCATCAACGGGCCACCCTA
TTCGAAGAAGGGAATGGAAAACGGACTGGCGTAGTCAATAAGCGTCTTCATATCTTAGCA
TTGTTGAGAGATACATAGTGTACTCCATATCGTTCTTTTTTTTGTATATATCAAGCCAC
ATATCCTGTTTCTTTAATCTTTTATACGCCGTAAGAATCGGGTACTGACATAAGTGTAAG
TAGCCGTACAGAGAACAAATATGACTAAATCGGTTGGTGATGAAGAGTCACAGTACATTG
AGGACCCTAGTTTTGCAGCAGCAGCTGCATTTACTGGCGGCAGGGACGGGGTTTCGTACA
GTAATCAGCGATTTGCTGAGGGTTCCGGCCATTCTTCTGACTTAGCAAAGTCATTAGAAG
ACTATCGGCCTCCTGATGAAAAGCCGTCCTCATTGTCATCTGTGGGGAAGGTGGCGCTA
ATGAGGAAGAGAAGGGCGGTAACGACGGCGGTCCCTTGGCAAGAATTCAAACAGGGCTTT
TTTCTCCAAGACTGCGAAATCATAGGAAAAGATTCTCTCGAAGTTTGTTTTGAACAACT
TCTTCATTGCTTGTGTGTGTATCGCTCATATCGATTTACTGGGGTGCCTGTTACGGAA
CAGATCGTTACTTTTTCAAAGTGAAAATATTGTTGTATTGCAGGATGCGCCATCTAATA
CTTCAGTTCAATCTATTTCCGCGATCATACCCTCATTGTTAGCGTCTGTCCCCGGGACAT
GGCATATATACAACGCAACATCATTTCATAGGAAATTTGGTACGACGAACTCCACCGAAA
TTGACAGAAAGATAGTCGATTTAATTTACGATGAGAGATACTGGCTGGCGTTAAACGTTA
AACCTAATGCTACAGACACTTTGTATAATTCTTTGATTAGCCAAGACGCAAACTCGGAGT
TCAATTCATCAATTTTTTTGAATCCGTGTTTGAAAGTGGTCGTGACCCATCGAGTGTTA
AATCGACCATTCTACCACTCATGCAACAATTGGAGGTCCGCCTTCAGAAATATTACGTCA
AGGAATATCTTCCCTCATTGATGAGCAACATCACTTCTAATGACAGAGATCTTAATATAA

ACATGGAGAACTGGGCGATTGCAGGACAGTTGTTGTTCACCTACAACGATTATCGTCCCT
TTGCTGATCGTATTCTAATGGCCCCTCTGCAGGTCGGTCTGATTTATTGTATTTTGTTAA
CCGTTTTACAACTGTCATTATATGGTAAGTTGCACGGAGAAATGGCCAGAGTTCTGAAGC
CAAAGCATATTTTAATCTACAGGCTTCTAATTTCCTGGGCAACTTATTTCTTCTTTCCA
TTGGATTCTGTACCGTATCTGCAATTTTAGGATCGATTTCACCCCCGCCTTTGGCAGAG
GAGGATTCGTAGTATATTGGATGTCTACGTGGTTGGTAATGATGGCTGTTGGTGGTGCCA
ATGAAAACGTTCTCAGCTTAGTTATAGCTTACTGCCCTCCATACCTGAGTATTTGGTTGA
TGACGTGGATCATATTAAATATTTCTGCTTCATTCTACCCAATGGTTTTGAACAACGAAT
TTTACAGGTACGGCTACATAATGCCAATCCATAATGCCGTGGATATCTATAAAGTGATTT
TTTTGAATTTAACCAAAAGAAAAATGGGAAGAAATTACGGTATTCTCGTGGCATGGGTTG
CCCTCAATACATCCTTGATGCCATTTTGTATGAAGTTTGCAGGTAAAAAAATGCAAAAAA
ATGCTATGCAAGCAGCAGAAGCCGCTGTCGCAGCAGCTACCCAGCGTGCTAGCCGCCCGG
CAGAGGCCAATACTGATAAAAATAACAACCCGCCCGGAAATTAA

>YGR197C, 547 aa (SEQ ID NO 186)
MTKSVGDEESQYIEDPSFAAAAAFTGGRDGVSYSNQRFAEGSGHSSDLAKSLEDYRPPDE
KPSSLSSVGEGGANEEEKGGNDGGPLARIQTGLFSPRLRNHRKKILSKFVLNNFFIACVC
VSLISIYWGACYGTDRYFFKVKNIVVLQDAPSNTSVQSISAIIPSLLASVPGTWHIYNAT
SFHRKFGTTNSTEIDRKIVDLIYDERYWLALNVKPNATDTLYNSLISQDANSEFNSSIFF
ESVFESGRDPSSVKSTILPLMQQLEVRLQKYYVKEYLPSLMSNITSNDRDLNINMENWAI
AGQLLFTYNDYRPFADRILMAPLQVGLIYCILLTVLQLSLYGKLHGEMARVLKPKHILIY
RLLISWATYFLLSIGFCTVSAIFRIDFTPAFGRGGFVVYWMSTWLVMMAVGGANENVLSL
VIAYCPPYLSIWLMTWIILNISASFYPMVLNNEFYRYGYIMPIHNAVDIYKVIFLNLTKR
KMGRNYGILVAWVALNTSLMPFCMKFAGKKMQKNAMQAAEAAVAAATQRASRPAEANTDK
NNNPPGN

>YGR250C, 2846 bp, CDS: 501-2846 (SEQ ID NO 191)
TCTTGTGTACGTACGATGTTTCTCCCGCTGATCCGATTACTAGCCGAAGACGTAAAATTG
GCGCTTGATTCAATTTATGCCCTTCCCGGGAATAGTTGACCAAAGGGCAAAAAAATTCAG
TCGGAGATTCCCTATTGGGCGGAATTTAGTAGATCTCTTTCCGTGCATAACGCCTGCCCG
TTAGTCGTTATTTCACGTTAACATTTTCTTGGCCACTGCGCTATATAAATAAATACATAT
ATATATGTCAAGCACAATAAAGAAACTTCCCTTAAATATTGAATAAGTAAATAATAGTTG
AAAAGTGCCTTTTGTTCGAAGGATTAGAGTGTTCTTAATTTTAGTTCGTTCAACGGTCTC
AAAAAAAGTGTGAACAAGTAAAGCATAGCACACATCCCAAATTACAAGGCACCTGATTA
AAAATCCAAAAATAAACCATAAGTTTTATTTTACTAAAAACATTATACGTGAAAGACAAA
CCGCATCAGAAGTTTCGAGGATGAATATTGCAGAAGAACCATCAGATGAAGTAATATCTA
GTGGCCCCGAGGATACAGATATCTGCAGCCAGCAGACATCAGCGAGCGCAGAAGCTGGAG
ACCAATCAATAAAAATTGAAAGGAAAACTTCCACTGGTCTTCAACTGGAACAATTGGCCA
ACACAAATTTATTAACCATAAGAATAAAATGGCAGTTACAAGAAGAAGAAGATGATCACT
GCAACTCTAGAATAACCGATCAAATAATGGACACAATACAGCACTACAAAGGTATCTCCG
TTAACAACTCTGATACAGAAACATATGAATTTCTTCCGGATACAAGGAGGTTACAGGTTC
TCGAACAAAATAAAGACATCTATCTTTACGAGCATGGAAGTCAAGAGTATGAGAAATCTT
ACAAAGATAACGAAGAGGAAGATGATTGGAGATACGATACCGTTTTGCAAGCACAATTCA
AGTACCCCAAGTCATTAGAAAATGCATGTACAGATATCTCGGAATTACTCAAGAGCGAAC
CTATTGGTCAGCATATTGATAAATGGTCTATCGGTGTGAACAAGCATGCACTAACCTATC
CTGGAAATATTTTGTCGGGGAATAGCAAAGAGCCTTTCTATTGGTGAACTAAGTTTCT
TATTTTCAAAATATGGACCAATTTTATCAATGAAATTGATATATGATAAAACGAAAGGCG
AACCTAACGGATACGGGTTCATCTCCTACCCCTTGGGTTCTCAAGCTTCACTTTGCATCA
AGGAACTTAATGGAAGGACGGTAAATGGCTCCACACTATTTATCAACTATCACGTTGAGC
GAAAGGAGAGAGAAAGAATCCATTGGGACCATGTCAAAGAAACAACAATGATGATAATT
TCAGGTGTCTCTTTATAGGCAACTTGCCTTATCACAATCCTGAAAAAGTAGAGACTTTGA
TTACACCTAAAGAAGTCATAGAAGTAATCAAGAAGGAGTTATCAAAAAAGTTTCCGGACT
TTGATATCATTTCATATTACTTTCCGAAGAGAAGTAATACAAGAAGCAGTAGTTCAGTAA
GTTTCAATGAGGAGGGGTCAGTAGAATCAAACAAATCTTCCAATAATACTAATGGAAATG
CCCAAGATGAAGATATGTTGAAGGGTTATGGTTTCATCAAGCTTATCAACCATGAACAAG
CACTAGCAGCCATCGAGACCTTCAATGGGTTCATGTGGCATGGAAACAGGCTCGTTGTTA

ATAAGGCGGTTCAACATAAAGTTTACAACAACCACAATAGCCATGACAGGCACCCTTCCA
TCAGTAACCACAATGATATGGAGGTTTTGGAATTTGCAAATAACCCAATGTATGATTACA
ATAATTATACATATGATAGATATTACTTCAACAATAATAAAAACGGGAACAGCAACGATA
CCTCCAATGTACGGTATTTTGATTCTGTAAGATCAACCCCTGTGGCAGAGAAAATGGATC
TGTTCTATCCTCAAAGGGAATCTTTCAGTGAAGGTCGTGGTCAACGTGTGCCTAGATTCA
TGGGCAACAAGTTTGACATGTACCAGTACCCATCAACTTCTTACAGCTTACCTATACCAA
TGAGTAATCAGCAAGAATCAAACCTATATGTCAAGCACATCCCTCTTTCTTGGACAGATG
AAGATTTATATGATTTCTACAAATCTTTCGGTGAAATAATCAGCGTTAAGGTCATTACTG
TTGGGGGTAGTAAGAACAAGTATCGTCAACAATCGAATGATAGCTCATCAGATAATGATC
TGCCAGTGGGATCATCAAGAGGTTATGGTTTTGTTTCTTTTGAAAGCCCATTAGATGCTG
CTAAGGCAATTTTGAATACAGACGGGTATCAAGTGAGCAAAGATCAAGTGTTATCTGTTT
CTTTCGCTCAGAAACGTGGTAATTTATCTTCAAGTGATGATGATGATCAATCCCAAACTG
ATAACTCATCAAAGTTCCAAAATTTTCAGCCACATAATGATTATCATAAGGCTTATCCAA
CAAAGTATAATAAGAAATTTATCAATGCCTTGATGACTCAGAACCAATCGCAACAGCAAG
TCTCGAGGGAAAATTATTTCATACCACTGCAGTACCCTAATACCAACACAAAGCCCGTGA
ACAGTTACAACTTAATAAGTGCAAACCAAAATAACGCTAACTGGATGATGCCAATGTTCC
CATCATTTGGGTTTATTCCACAGGTGCCGCCAGTGCCCTATATAATACCTCCGCAGAATC
CTGCAGCAAATCATATTCCTATAATGGCAAACGGTAGTAATGAAGAGGAAGAATTTTCTA
GTGGTGATTATTCTATGGACTACTAG

>YGR250C, 781 aa (SEQ ID NO 192)
MNIAEEPSDEVISSGPEDTDICSQQTSASAEAGDQSIKIERKTSTGLQLEQLANTNLLTI
RIKWQLQEEEDDHCNSRITDQIMDTIQHYKGISVNNSDTETYEFLPDTRRLQVLEQNKDI
YLYEHGSQEYEKSYKDNEEEDDWRYDTVLQAQFKYPKSLENACTDISELLKSEPIGQHID
KWSIGVNKHALTYPGNIFVGGIAKSLSIGELSFLFSKYGPILSMKLIYDKTKGEPNGYGF
ISYPLGSQASLCIKELNGRTVNGSTLFINYHVERKERERIHWDHVKENNNDDNFRCLFIG
NLPYHNPEKVETLITPKEVIEVIKKELSKKFPDFDIISYYFPKRSNTRSSSSVSFNEEGS
VESNKSSNNTNGNAQDEDMLKGYGFIKLINHEQALAAIETFNGFMWHGNRLVVNKAVQHK
VYNNHNSHDRHPSISNHNDMEVLEFANNPMYDYNNYTYDRYYFNNNKNGNSNDTSNVRYF
DSVRSTPVAEKMDLFYPQRESFSEGRGQRVPRFMGNKFDMYQYPSTSYSLPIPMSNQQES
NLYVKHIPLSWTDEDLYDFYKSFGEIISVKVITVGGSKNKYRQQSNDSSSDNDLPVGSSR
GYGFVSFESPLDAAKAILNTDGYQVSKDQVLSVSFAQKRGNLSSSDDDDQSQTDNSSKFQ
NFQPHNDYHKAYPTKYNKKFINALMTQNQSQQQVSRENYFIPLQYPNTNTKPVNSYNLIS
ANQNNANWMMPMFPSFGFIPQVPPVPYIIPPQNPAANHIPIMANGSNEEEEFSSGDYSMD
Y

>YHR001W-A, 797 bp, exon1: 501-506, intron1: 507-569, exon2:
570-797 (SEQ ID NO 195)
TTCTATTCCGGCTTATAAAAAGCATGGAATCCAAAAGAATTAGGCTTCTCATTCTATTTT
AATTATACTAGTACGATTTCTCACTCTGTAATTTAATATCAGTGTAATATGCACCTAGTT
ATGGGTAGTTTTTGCTAACGTTACGAGCCGCGAAACTGTCCTCAATCTTCACCACTACCT
CTAATGACTGAAGAATGCTATGCGATATAACGCTGTCGCACTTTGAATATATACTTATAT
TTACATAGTTTTCAAGTGCGTATTACTATTGCAAAGTAGTATTTTGTCACGTGATTTTGA
TCCAATTAAAACTAAATATGGTTCAACCCGTTGTTTCCGCATCAAAAAACCATACCATTT
ATCAAGGGGACGGGATATATCACATAACAGTTTGAATGCATAATTTGTTATAGATATCTT
CTGGAATAATCTTCACAGCAAAAGCGCAAGTCGAATAATATATCGATAAATACAATCCAT
AAGACTTAAAACTAACCTCAATGGCGGTAAGTATCCTATCATATTATGTGAGCTAGAACC
GAATTAGTATACTAACATTTATAATACAGTACACTTCTCATCTGTCTTCAAAAACTGGTC
TACATTTCGGTAGACTTTCTTTAAGAAGTTTAACAGCTTATGCTCCGAATTTAATGTTAT
GGGGTGGTGCTAGCATGCTTGGGCTATTTGTATTCACAGAAGGATGGCCTAAGTTTCAAG
ATACGCTATACAAAAAGATTCCGTTGTTAGGACCTACATTGGAAGATCATACTCCACCAG
AAGATAAACCTAATTGA >YHR001W-A, 77 aa (SEQ ID NO 196)
MAYTSHLSSKTGLHFGRLSLRSLTAYAPNLMLWGGASMLGLFVFTEGWPKFQDTLYKKIP
LLGPTLEDHTPPEDKPN >YJL142C, 893 bp, CDS: 501-893 (SEQ ID NO 225)
TGCTGAATTATTTTTGGGTATACCGATCTTCCAGGCGCTTCTGAATATAACCAATTAAC
AAGAATAATAGACACGCTTGGATATCCTCCATCGTGGATGATAGATATGGGTAAAAACTC
TGGAAAATTTATGAAGAAATTGGCACCAGAAGAAAGTTCTTCTTCTACACAAAAGCATCG
TATGAAAACTATTGAAGAGTTTTGCAGAGAATACAATATAGTGGAAAAGCCCAGTAAACA
ATATTTTAAGTGGAGAAAGTTACCAGATATTATTAGAAACTACAGGTATCCTAAAAGCAT
ACAGAACTCCCAAGAACTTATCGACCAAGAAATGCAGAATAGGGAGTGTTTGATCCACTT
TTTAGGCGGTGTGCTAAATTTGAACCCGTTAGAAAGATGGACACCACAACAAGCTATGCT
ACACCCCTTCATAACAAAGCAGGAGTTTACAGGTGAGTGGTTTCCTCCAGGATCGTCTTT
ACCGGGTCCTTCAGAAAAACATGACGATGCAAAAGGCCAGCAAAGTGAATATGGAAGTGC
GAACGACTCTAGTAACAATGCAGGCCACAACTATGTCTATAATCCTAGCTCTGCCACTGG
TGGTGCTGATAGCGTCGACATTGGTGCTATCAGTAAAAGGAAGGAGAATACATCTGGCGA
CATCTCCAATAATTTTGCTGTTACTCATTCTGTTCAAGAAGGGCCAACAAGCGCGTTCAA
TAAACTTCACATTGTCGAAGAATAAATCGTTATTTTGTCTGACTTTTCTTAACTACCCAT
TTCATTTTATTACGGCTTGGTGCCATAATGATATACTAAATAAATATGAATTTTGCCTTT
TCTTAATTTTCCTTATACGTATAGTCATTACAATTAATAAAGTAACATTATAA >YJL142C, 130 aa (SEQ ID NO 226)
MTMQKASKVNMEVRTTLVTMQATTMSIILALPLVVLIASTLVLSVKGRRIHLATSPIILL
LLILFKKGQQARSINFTLSKNKSLFCLTFLNYPFHFITAWCHNDILNKYEFCLFLIFLIR
IVITINKVTL >YJL144W, 815 bp, CDS: 501-815 (SEQ ID NO 227)
AGAAAGAAGTTCGTGGTATTAACCGACGGCAGCAAGTTGGGTCAATACTTGAAGGATTGC
CCATATGAAGGGTATGGCGGGAAAGATAAGAAGAACAATCTGACCAAGCAAAATGTCACA
AATGTCCATCCAACAGAATACGGCCTTTACATTTTACAAAAACAAATCATCGAGGACGTT
GAGTGATTTGTTGGCATGATCTAATAATAGTCTCTTATATAAACCCTATAATAATTTCTT
ATTTTTGCCTTATATTCAGGTAAATCACCATCTAACTGTATTATCTCTCACGTATCTTCA
CTTATATGGCTCAGAAAACACCGTACGAAACGAAGGGGCTGCGAAATGTTTCTAGAAGG
TAATGGCAATAATAGGGATACAGATCGATCAGATCCGCCTATATAAAGACAACGCACCG
AAGGTGAACAAGATCGCAGATAAAGGTATTTACAAGGGAAAAAGTCAGCAAAAACAAGA
GATAAGATAACAAGAAGAAGATGTTAAGGAGGGAAACTTCAACAATATACAGGACACACA
AAAAAAGCAACAGTAGTATACTCAGGAGCCAGCGGGACCAGACTAGAGTGGATTCCTTGG
TAGAGGAGTCTCCCATGGGCGATTTCGGGATCAATAACCAGCCTACACAGCCTGGCGTGA
TATACTACTTTGTAGAGCTGACTAATTTAGGCATACAGGAAAACACAAGCAGTAATAATA
ACAACAACAATAATCATGGTGACGATGAAAACGGCAGTCGATACGGCCACGGCAGCAGTC
TGGGTGGAGACGTTCACTCTCGCCGTTGTTCATGA >YJL144W, 104 aa (SEQ ID NO 228)
MLRRETSTIYRTHKKSNSSILRSQRDQTRVDSLVEESPMGDFGINNQPTQPGVIYYFVEL
TNLGIQENTSSNNNNNNNNHGDDENGSRYGHGSSLGGDVHSRRCS >YJL166W, 785 bp, CDS: 501-785 (SEQ ID NO 231)
TGAACAGCTATACCACGAATATGAAGAGTCTATTGCCAAGGATTTGAAGGCCAAAATTTC
TCAGGTCGATGAGTCTCGTGGCTTCAAAGCTGATGTCTTAACTGCGTTCTTGAACAAAGT
TTACAAGAGAAGCAAATAGAACTAACGCTAATCGATAAAACATTAGATTTCAAACTAGAT
AAGGACCATGTATAAGAACTATATACTTCCAATATAATATAGTATAAGCTTTAAGATAGT
ATCTCTCGATCTACCGTTCCACGTGACTAGTCCAAGGATTTTTTTAAGCCAATGAAAAT
GAAGAAATGCGTGATCGGAAATTACGGGTAGTACGAGAAGGAAACTTGAGCCACCCCCA
AATTTTATTCATATAATAATAGGAAAAGCAACGACCTCATCTCTCGAACATTGTTTACTT
GAGCAAGTCCGATTAAGAGTAAGTTGTCGTACGTTAAATACAAATAATCAACAAAACACT
ACACAAAAACTTCTACGATAATGGGTCCTCCAAGCGGTAAAACTTACATGGGATGGTGGG
GTCACATGGGTGGTCCAAAGCAAAAAGGTATAACCTCATATGCTGTGTCTCCATATGCTC
AAAAGCCATTACAAGGTATTTTCCATAACGCTGTATTCAATAGTTTTAGAAGATTTAAGT
CTCAATTTCTATATGTATTAATACCTGCGGGAATTTATTGGTACTGGTGGAAGAACGGTA
ACGAGTATAATGAATTTCTGTACAGCAAAGCTGGTAGAGAAGAGCTGGAAAGAGTTAATG

TTTAA

>YJL166W, 94 aa (SEQ ID NO 232)
MGPPSGKTYMGWWGHMGGPKQKGITSYAVSPYAQKPLQGIFHNAVFNSFRRFKSQFLYVL
IPAGIYWYWWKNGNEYNEFLYSKAGREELERVNV

>YKL117W, 1151 bp, CDS: 501-1151 (SEQ ID NO 247)
TTATAGAACTGTTTTATTGTTTAAAAGAGCTTGTTATAGTAATCTAAGTGGAAATACACT
AACAGTAAATAGGGCGTGTGGCGTAGTCGGTAGCGCGCTCCCTTAGCATGGGAGAGGTCT
CCGGTTCGATTCCGGACTCGTCCAATCTTTTTATACTTATTAATAATTTTTTTCCTGCCG
TTACTTGCTTTTAAAATAACTGCCTTTTATGAATACAGAGTATAATTTTTGATATACAAA
GAGGTTGACTGTGATAATCAATACTTAATTTGTGGTTATTGGTACACATATACCTACAAA
AGTTACCAACAAACTGTTCGACTTTTAATGCTACCCGCCTTCCGAGTGTTTTTGAAGGGG
CGGAGAGGAGCGGCAAGAATTAGCATGGAAAAAAGCATAAAAAGACGAAATGGGTGGCAA
TGTATTAACTTGTTCGAGAAACCTAGTGGACTCAATTCATTACAACAACAAGTTCCCAAG
ATCATCGATTCATAATAGTCATGTCCGATAAAGTTATTAACCCTCAAGTTGCATGGGCTC
AAAGGTCTAGTACTACTGATCCAGAAAGAAATTATGTCTTAATAACTGTGTCAATTGCAG
ACTGTGATGCCCTGAGTTAACCATTAAGCCATCATACATCGAATTAAAGGCTCAATCAA
AGCCTCATGTTGGCGATGAAAATGTCCATCATTATCAATTACACATTGATCTATACAAGG
AAATTATACCTGAAAAAACAATGCATAAGGTTGCTAATGGCCAGCACTACTTTTTGAAAT
TGTATAAAAAGGATTTAGAATCTGAATACTGGCCACGTTTGACAAAGGAAAAGGTGAAGT
ACCCTTACATCAAAACTGATTTCGATAAATGGGTTGATGAAGATGAACAAGACGAAGTTG
AAGCTGAAGGTAATGATGCCGCTCAAGGAATGGATTTCAGCCAAATGATGGGAGGTGCTG
GAGGTGCTGGAGGTGCTGGAGGCATGGACTTCAGCCAAATGATGGGAGGTGCTGGTGGCG
CTGGTTCTCCAGATATGGCTCAATTGCAGCAATTATTGGCTCAAAGCGGTGGTAATTTGG
ACATGGGAGATTTCAAAGAAAACGATGAAGAAGATGAAGAAGAGGAAATAGAGCCGGAAG
TGAAAGCTTAA

>YKL117W, 216 aa (SEQ ID NO 248)
MSDKVINPQVAWAQRSSTTDPERNYVLITVSIADCDAPELTIKPSYIELKAQSKPHVGDE
NVHHYQLHIDLYKEIIPEKTMHKVANGQHYFLKLYKKDLESEYWPRLTKEKVKYPYIKTD
FDKWVDEDEQDEVEAEGNDAAQGMDFSQMMGGAGGAGGAGGMDFSQMMGGAGGAGSPDMA
QLQQLLAQSGGNLDMGDFKENDEEDEEEEIEPEVKA

>YKR075C, 1424 bp, CDS: 501-1424 (SEQ ID NO 257)
TTCAACAGAAATGCCGTAGCCGGAAAAACCGAAAGCGGGGGACAGTGAAGCGTGAGAGGG
GCGAGACAGGGGGAACTTGAATGGGGTATTTTGCTTTTGCTGCATTTTTTCCGCTGGTAC
CTCTATCTTTAGGCGACCGGAAAAATTCATTTTCTCATCTTTTTTTTTTTTCGTTTCCG
ACTCGATACTCTTTACAAAGAAACCCCCGCGGGGAAATGTTAGATTTGAGCTTTTTCCGC
CAGGAAAAGAAAAAACCTGGGGACATTAATCTTGTTTTTTCTTTCTTCTTTTGTCTTCCC
TTGGATGACTGCAGAAAAAGTACAGTTACCGGGTCTTAGCAAAAACAAACATATATATAT
ATATATATGAAAGCGTATGGTCAACACGGTTTTATAGGTTTTACTTTTTGCATTCAGTTC
AACTTTGGCCCTTTCTCTTATCGCATTCAGATACTACACACAAGTGTTCATACACACACA
AATAGATACATATACAGAAAATGACTAGTTTGGACGATACAATAATTTCGTACCAGAATA
TAATGTTACTGGATAACATGACCAACTACAACAAGCCTGCGATTGACTATTTCCATCATG
AATTTAATGATGCAAGCTTGGAAATATCGGCTTCATGGACACTACTATTGAAGATGCGCA
AACATAAACTACTTCGATTACCAAGTTGCTCTTCAGAGGACGTGCTAGATTACAACATGT
ACCTCGTTAGGCTACATCATTGCCTCTGGAGGCGTTGGTCCATAAATCACTATGGTTTAC
AGAACTCCAAATCCAATCCACTGTCCATCAACTGGAACAAAGAAACCGATGTAACGGTGT
TGTACGGTCCAGATTTGACTAACATAGATAGTAATGAAAACGAAATATCGCCGGTCCAGA
ACCAAATTGACCAGAAACAAACAAAAAATCTAAATCTGCTTTAAAGAAAAATACGGAAT
GCTGGGTAACCGAGGAGGTGGATGAGATTAACGCTTCTATAGAGAGCAATGACAACGCTT
TGGTGAAATTAGAAGACATTTCATGCCCATCGTCTGTTGATTCTCACACGTCTTCCATTT
TCGACCAGCATTCTACATGCACTAAAATTTCCTCCATAGATGAAGATTCTGAAGACCTTA
TGAACGAAAGAAGGAACAATTCCCCAGGAAGTTGAAGTTTAACCAAGCCGTGATGAAGA
GGGAGATCGACTCAAAGGGGACTATCCGCGAATCCCTCATCAACATAAACGATATCCAAC

ATTCCCGCCACCATCGCCGTCACCATCGTCGCCATCATCACCATCACCATCAAAATAGTT
CTCATTCTGATGAAACAATAAAAGAAGCTCATTATGAGTTCAGCAACTATACATTTGGCA
CTATGGAAGAAGACATTTTTTATAGGAACCAGGTTGTTTTTTAA

>YKR075C, 307 aa (SEQ ID NO 258)
MTSLDDTIISYQNIMLLDNMTNYNKPAIDYFHHEFNDASLEISASWTLLLKMRKHKLLRL
PSCSSEDVLDYNMYLVRLHHCLWRRWSINHYGLQNSKSNPLSINWNKETDVTVLYGPDLT
NIDSNENEISPVQNQIDQKQTKNLKSALKKNTECWVTEEVDEINASIESNDNALVKLEDI
SCPSSVDSHTSSIFDQHSTCTKISSIDEDSEDLMNEKKEQFPRKLKFNQAVMKREIDSKG
TIRESLININDIQHSRHHRRHHRRHHHHHHQNSSHSDETIKEAHYEFSNYTFGTMEEDIF
YRNQVVF

>YLR216C, 1616 bp, CDS: 501-1616 (SEQ ID NO 279)
GAAGAATACAAAGAGGTCCAAGAAGACGAAGACCCGGATGTGTGGGACACGAGAATATCC
AAGACCGGATGCTACGTAGAGAACCTCGCATTACAGCTGTGCCATGCCGAAACAGGTGAC
TGGAGGCAGTGCTTCAACGAGATGGCGTTATTTAGGAAGTGTTGGGAAAAGAATGGTAAT
AGAGAGCGCGTAAGCACAGTGGACGTGGATGGGACGACCAGTAAGGATTCGGAAAAGAAG
AAATGAAAATCTAAATGTCGTGATGTATAACTTGTATATAATAGACAGCTGCAGTGATCG
AAACACATTGTTTCCCTTTATAGAACATAACTGTTACGCTTTTGAACGGCATTTCTATGA
GCTTCTAGAATATTTTTCCGCCCTAGCTGGAGAAAGTTCAGACAGAAAATTATTTAAATA
AGTCGAATATCAGAGGTGCTGATGCGCTCACATCACATAGAAACTGGTAAGACAATATT
CAGGCGATCAAGGAGTAAAAATGACTAGACCTAAAACTTTTTTTGATATTTCTATTGGAG
GTAAACCCCAAGGCCGTATAGTTTTTGAGTTGTACAATGACATAGTGCCTAAAACGGCTG
AAAATTTTTTGAAGTTGTGTGAAGGAAATGCTGGTATGGCAAAGACTAAACCTGATGTAC
CATTGTCGTACAAGGGTTCCATTTTCCACAGAGTGATCAAAGACTTCATGTGTCAATTTG
GTGATTTTACCAATTTTAATGGTACTGGCGGTGAGAGCATATACGATGAAAAATTCGAGG
ATGAAAATTTCACTGTTAAACATGATAAACCATTCCTTCTATCCATGGCCAACGCCGGTC
CAAATACCAATGGATCTCAAGCTTTCATAACCTGTGTTCCTACACCTCATTTGGACGGGA
AGCACGTTGTGTTTGGTGAAGTGATTCAAGGTAAAAGAATTGTTCGTTTGATTGAAAACC
AACAATGTGACCAAGAAAACAACAAGCCATTGCGTGATGTAAAGATTGATGACTGTGGCG
TGTTACCTGACGATTATCAAGTGCCAGAGAATGCCGAAGCTACACCAACAGATGAGTACG
GCGATAATTATGAAGATGTTTTAAAACAAGACGAAAAAGTTGACTTGAAGAATTTCGACA
CCGTCTTGAAAGCTATCGAAACGGTAAAGAACATTGGTACTGAACAGTTCAAGAAACAGA
ACTATTCCGTGGCTTTAGAAAAATATGTCAAATGTGATAAATTCTTGAAAGAGTATTTCC
CAGAAGATTTGGAGAAGGAACAAATTGAAAAAATCAATCAATTGAAAGTGTCTATTCCAT
TGAATATTGCCATCTGTGCTCTTAAATTAAAAGATTACAAGCAAGTATTAGTAGCCTCAT
CGGAGGTGTTATATGCCGAAGCGGCTGACGAAAAAGCCAAGGCCAAAGCTTTGTACCGTC
GTGGCCTGGCCTATTACCATGTTAATGACACAGATATGGCTCTCAATGACCTAGAAATGG
CCACTACTTTCCAGCCAAATGACGCTGCCATTTTGAAAGCTATTCATAATACTAAATTAA
AAAGAAAGCAACAAAACGAAAAAGCTAAAAAGTCTCTTTCGAAGATGTTCTCCTGA

>YLR216C, 371 aa (SEQ ID NO 280)
MTRPKTFFDISIGGKPQGRIVFELYNDIVPKTAENFLKLCEGNAGMAKTKPDVPLSYKGS
IFHRVIKDFMCQFGDFTNFNGTGGESIYDEKFEDENFTVKHDKPFLLSMANAGPNTNGSQ
AFITCVPTPHLDGKHVVFGEVIQGKRIVRLIENQQCDQENNKPLRDVKIDDCGVLPDDYQ
VPENAEATPTDEYGDNYEDVLKQDEKVDLKNFDTVLKAIETVKNIGTEQFKKQNYSVALE
KYVKCDKFLKEYFPEDLEKEQIEKINQLKVSIPLNIAICALKLKDYKQVLVASSEVLYAE
AADEKAKAKALYRRGLAYYHVNDTDMALNDLEMATTFQPNDAAILKAIHNTKLRKQQNE
KAKKSLSKMFS

>YLR346C, 806 bp, CDS: 501-806 (SEQ ID NO 289)
CTTATCTCAGGGTACCCATAATTTCAACCATCCTTAGCTTCCATTAAAAACACAATGAGT
TGCGTTACTAGCGAAGCGGCTTATCTGTTAATTCTTGCTTGCAAACATCTTAGCTGAAAG
TGAAAAGGCACAGCGCACCTGCTGAATGCTCAACGTTTGTAATAATCCGCCTATTTCCGC
GGAATCAATAGGGCTCCTAGCAGGCCGCCATCAATTTTCAGCGTGCCGCATTAAAATTAT
ATTACCAAGATTTCCATTTCCGCGGCTGATTCCTATCAATATTAAGTAATCAATCTTTTC

CTCGTGATTCTTTGTGATGCTCATTCACAGAGGACTAATTAAGACATGTAGCACAATATA
TTCATATAAAAGTTGGTGCAGTTAATGATTAATTGCATTGTTTTCCTTGTTTCTTTCTGT
TATACCTGTCGAATTAAACATAAAGTGTATATGAATTTTAAGGGGCACAAATAACAAAGG
ATTATTTATCACCTTTAATAATGCAATCGATCAGTAATTGTCCCATCGGGTTAGTTTCAA
AAAACACAATCAATTCAGCTTCCACTATTGCAGAGTGGGTAGCATGTCCATGGAAATATA
TCAACGTTGTTGGTTCAGGCAGATATGTGAGCAATAAACCTGATAAAATTACCAGATATG
ATTTACTCAAGGCTGCCCAGGAAGCGGAAATGCAGGAGTTGCTTACAAGAAATGATATGA
AAGGTAGACATAAACGTAATAAGAAAAGTAAGATAGCATTGGAGACTATAGCGGAAGAAA
ACTCTTCAACTGAAAGCCTTTTTTAA

>YLR346C, 101 aa (SEQ ID NO 290)
MQSISNCPIGLVSKNTINSASTIAEWVACPWKYINVVGSGRYVSNKPDKITRYDLLKAAQ
EAEMQELLTRNDMKGRHKRNKKSKIALETIAEENSSTESLF

>YML129C, 713 bp, CDS: 501-713 (SEQ ID NO 297)
TAATCAACTTGGCCAAGCAGAATACGCAATGGTTGTTCGGCACTGTTAAGGAGCCTGCTT
ACAAGAGGTACCTACATAACGTTAAAAACTGGTCGAAAAGCATATTAGGGTTCAACTAAT
GATTGGGGTGTCAACGTAATGTACTTTTCTCCCCAATTTTTCTTTTCATCCGTATATTTT
ACCGTAAAATGGACAAGCTAATAGCAAAACGAAAAAACACGTTGTCACTTCTATATAACT
TTGCTTAAGTAAGTATTTTGTCTTTATAATGTTACATACTGTGAAATACACTCTTTAGAA
AACACTATTTCCTCACTCTCGGAAGCAGATTTCGAAGTTCTTCCTTACTTCTGAGCTTTG
CTTCTCCTTCCTTGCGATTAATGTTACCCGGTATACGAAATCGGAGAGGATCAGAATAAA
TGCATTGAAAGGAGCATAAATCTATACAGCGGTTTGGCAATGGTGAGAGGAAGAGAACAA
AAAATAGAACGCAGATAGTCATGTCCAAATACGCTTGGTATACCAGAGTTACAGATACAT
TACATCGTCTAACGGTACTGACGTTGGTTGGTGGTACGTTATACATGTCGGGTGGCTTAG
CTTACACTTTATACATGAACGGTAAGAAGTACGAACAACAAGTGACCCAACAAAAGGCAC
TTGAAGAAGACAATCAACAACTGCAAAGTCCTACTGCACCTCCTACCGAGTAA

>YML129C, 70 aa (SEQ ID NO 298)
MSKYAWYTRVTDTLHRLTVLTLVGGTLYMSGGLAYTLYMNGKKYEQQVTQQKALEEDNQQ
LQSPTAPPTE

>YML132W, 1640 bp, CDS: 501-1640 (SEQ ID NO 299)
GTAACTTGGTTCTATGAATCTTCATGTCAGATACGTAGGACAGACTCTTTCCTGTGTAAA
TATTTGTGACAGCTACGTCTATTTTCTACTAGATGTTTACACAGTTTTGTCACAGGAAAT
CTACGCTTAAAATATGTATTTCATTCAAGCGGTAACCGCTGTACGAGCAGTGACATTGCT
GGTCGCACCCTAAATGTGAACCAACGTTACGGCACACCGTGATGTACCCGCATTAAAGTT
TTGTAAATTCGTTATTACGATTATCGAGTTGGCTAGATAGAAACCGGAAATGTAATGGA
TGCCCTTTTCGAATAGCTGAGTTTCTTTGCCTAAAATAGCCCAATATTGTTGCCCTTTTT
CTATCACGAGGTTACTGAGCCATTGCATGAACGCGCGCGCCTCGGCGGCTTTTTTTTTCT
GCTGTGCTGTATAAAAGCGAAAAGCCAGAAGTTACTATCTCGAATAAAAAACCCCTCGAA
CTGCCATCTCACTACCGAAAATGAAAGAGAATGAACTTAAAAATGAGAAGAGTGTAGATG
TATTATCCTTCAAACAGCTCGAATCCCAAAAGATTGTTCTACCTCAAGATCTTTTCAGAA
GCAGCTTTACCTGGTTTTGTTATGAAATTTACAAGTCCTTAGCGTTTCGCATCTGGATGC
TATTATGGCTACCACTTAGCGTCTGGTGGAAACTTTCCAACAATTGTATTTACCCACTTA
TAGTTTCACTTCTGGTCCTGTTTCTGGGACCAATATTTGTCCTTGTTATTTGTGGACTTT
CTCGTAAGCGTTCCTTATCGAAACAACTCATTCAGTTTTGCAAAGAGATTACTGAAAACA
CACCAAGTTCTGATCCTCATGATTGGGAAGTTGTTGCAGCAAATCTAAATTCGTACTTAT
ATGAAAATAACGTTTGGAATACTAAGTACTTTTTTTTCAATGCCATGGTCTGTCAAGAAG
CGTTCAGAACAACCCTTCTCGAACCATTTTCTTTGAAAAAAGATAAAGCTGCCAAGGTTA
AGTCATTTAAGGATTCCGTCCCTTACATTGAAGAAGCATTGGGAGTTTATTTTACAGAAG
TTGAAAAACAATGGAAATTGTTTAATACTGAAAAATCATGGAGCCCTGTTGGCCTGGAAG
ATGCTAAACTTCCCAAGGAAGCTTACCGATTTAAGCTTACTTGGTTTTTAAAGAGGATTT
CCAATATTTTTATGTTGATACCATTCCTTAATTTTTTGTGCTGCATATATGTGTCACGGG
GAATGTGCCTTCTATTACGCACCTTGTATCTCGGGTGGATTCTTTTCATGTTGGTACAAG
GTTTCCAAAATATAAGGGTTTTGATTATGAGCATGGAACACAAGATGCAGTTCTTGTCGA

CTATTATAAATGAGCAAGAAAGTGGTGCGAATGGATGGGACGAAATTGCAAGGAAAATGA
ATAGGTACTTGTTTGAGAAAAAAGCCTGGAAGAATGAAGAGTTTTTCTTCGACGGGATTG
ACTGTGAATGGTTTTTTAACCACTTCTTCTACCGCGTTCTATCTGCGAAGAAATCTATGT
GGCCTTTACCATTGAATGTGGAACTATGGCCATACATTAAAGAAGCGCAATTATCCCGCA
GTGAGGTGCTCTTAGTGTAG

>YML132W, 379 aa (SEQ ID NO 300)
MKENELKNEKSVDVLSFKQLESQKIVLPQDLFRSSFTWFCYEIYKSLAFRIWMLLWLPLS
VWWKLSNNCIYPLIVSLLVLFLGPIFVLVICGLSRKRSLSKQLIQFCKEITENTPSSDPH
DWEVVAANLNSYLYENNVWNTKYFFFNAMVCQEAFRTTLLEPFSLKKDKAAKVKSFKDSV
PYIEEALGVYFTEVEKQWKLFNTEKSWSPVGLEDAKLPKEAYRFKLTWFLKRISNIFMLI
PFLNFLCCIYVSRGMCLLLRTLYLGWILFMLVQGFQNIRVLIMSMEHKMQFLSTIINEQE
SGANGWDEIARKMNRYLFEKKAWKNEEFFFDGIDCEWFFNHFFYRVLSAKKSMWPLPLNV
ELWPYIKEAQLSRSEVLLV

>YMR009W, 1040 bp, CDS: 501-1040 (SEQ ID NO 301)
ACCGGTATTTTCATCTCTTCTAGATCAAGACTAACTGCTCGTTCAGTACAAGTATTTTAC
GATAGTCCATATTACTCTTCAATTAATATTTTTTTTTATATTCTGGCCCGTTTTTGACA
CAATTTTTTCCTTCTCTTTTTCTCCCTATAAACTATGCAGAAGTAGCGATAATCACGATC
TTGTTAATGATTCACATGTGCGCAAGTCGTATTGTCTGTCTAGATAGTGAGATGCCTTCT
AAATAACAGGAGAGAGGCAAGATAGCATAACGGCGCAATGAAGGTAATTTCTGCCAGTTT
TCTTTGCATTGACGACTGAAAGGGCCCTTGTAAGAGCCGCTCGACAGGGCGACGCCACAG
TAGAGTCGCTAACACCGAAATATGCATATTGAAAAACATCAAAGTATAAAAGAACAAAGA
GGGTGGCATCTGCAGATCAAAAAAAACAATAACCACCAAACAAGACACTAAAAAAGGTCG
TAAAAAGGTCAAAAGTTAGAATGGTTAAGGTATATATTCATGACAACAAGGTTGACTCCG
ATTATCGCGCACCCCACAATTCTGGAACAGAACTTTCCCTGGATGAATTAGCCAAGTTAG
GAGTGATTTATAAATACTGTGCAAATGAGGAAGAAGTGAATGAAATTGCTAGGCAAAGAG
AATATAAAAATAGAGATGTGGTCAACATCTGCGAAGGTTCCTTCAAAAGTGAAGCAGAGT
TTAATGAAAAACTAGCAACATTCTACCAAGAGCATTTACATGAAGACGAAGAAATAAGAT
ACTGTCTCGAGGGTGCTGGATACTTTGACGTCAGGGATGCTTCCACACCAGAGAACTGGA
TTAGGTGTTTGGTAGAGTCAGGTGATTTACTGATTCTTCCACCAGGCATCTATCATCGTT
TCACCTTGACAACTAGCAACCACATCAAGGCCTTGAGACTGTTTAAGGACGAGCCCAAAT
GGCAAGCTATCAACAGGTCAAATCAGGCTGATTCATTGCCTGTACGCAAGGACTACATTG
CCCTGATCAATCAGTACTAA

>YMR009W, 179 aa (SEQ ID NO 302)
MVKVYIHDNKVDSDYRAPHNSGTELSLDELAKLGVIYKYCANEEEVNEIARQREYKNRDV
VNICEGSFKSEAEFNEKLATFYQEHLHEDEEIRYCLEGAGYFDVRDASTPENWIRCLVES
GDLLILPPGIYHRFTLTTSNHIKALRLFKDEPKWQAINRSNQADSLPVRKDYIALINQY

>YMR011W, 2126 bp, CDS: 501-2126 (SEQ ID NO 303)
GCAGCTTCACTTTTAAGTTTCTTTTTCTCCTCACGGCGCAACCGCTAACTTAAGCTAATC
CTTATGAATCCGGAGAAAAGCGGGGTCTTTTAACTCAATAAAATTTTCCGAAATCCTTTT
TCCTACGCGTTTTCTTCGGGAACTAGATAGGTGGCTCTTCCACCTGTTTTTCCATCATTT
TAGTTTTTCGCAAGCCATGCGTGCCTTTTCGTTTTGCGATGGCGAAGCAGGGCTGGAAA
AATTAACGGTACGCCGCCTAACGATAGTAATAGGCCACGCAACTGGCGTGGACGACAACA
ATAAGTCGCCCATTTTTTATGTTTTCAAAACCTAGCAACCCCCACCAAACTTGTCATCGT
TCCCGGATTCACAAATGATATAAAAAGCGATTACAATTCTACATTCTAACCAGATTTGAG
ATTTCCTCTTTCTCAATTCCTCTTATATTAGATTATAAGAACAACAAATTAAATTACAAA
AAGACTTATAAAGCAACATAATGTCTGAATTCGCTACTAGCCGCGTTGAAAGTGGCTCTC
AACAAACTTCTATCCACTCTACTCCGATAGTGCAGAAATTAGAGACGGATGAATCTCCTA
TTCAAACCAAATCTGAATACACTAACGCTGAACTCCCAGCAAAGCCAATCGCCGCATATT
GGACTGTTATCTGTTTATGTCTAATGATTGCATTTGGTGGGTTTGTCTTTGGTTGGGATA
CTGGTACCATCTCTGGTTTTGTTAATCAAACCGATTTCAAAGAAGATTTGGTCAAATGA
AATCTGATGGTACCTATTATCTTTCGGACGTCCGGACTGGTTTGATCGTTGGTATCTTCA
ATATTGGTTGTGCCTTTGGTGGGTTAACCTTAGGACGTCTGGGTGATATGTATGGACGTA

GAATTGGTTTGATGTGCGTCGTTCTGGTATACATCGTTGGTATTGTGATTCAAATTGCTT
CTAGTGACAAATGGTACCAATATTTCATTGGTAGAATTATCTCTGGTATGGGTGTCGGTG
GTATTGCTGTCCTATCTCCAACTTTGATTTCCGAAACAGCACCAAAACACATTAGAGGTA
CCTGTGTTTCTTTCTATCAGTTAATGATCACTCTAGGTATTTTCTTAGGTTACTGTACCA
ACTATGGTACTAAAGACTACTCCAATTCAGTTCAATGGAGAGTGCCTTTGGGTTTGAACT
TTGCCTTCGCTATTTTCATGATCGCTGGTATGCTAATGGTTCCAGAATCTCCAAGATTCT
TAGTCGAAAAAGGCAGATACGAAGACGCTAAACGTTCTTTGGCAAAATCTAACAAAGTCA
CCATTGAAGATCCAAGTATTGTTGCTGAAATGGATACAATTATGGCCAACGTTGAAACTG
AAAGATTAGCCGGTAACGCTTCTTGGGGTGAGTTATTCTCCAACAAAGGTGCTATTTTAC
CTCGTGTGATTATGGGTATTATGATTCAATCCTTACAACAATTAACTGGTAACAATTACT
TCTTCTATTATGGTACTACTATTTTCAACGCCGTCGGTATGAAAGATTCTTTCCAAACTT
CCATCGTTTTAGGTATAGTCAACTTCGCATCCACTTTCGTGGCCTTATACACTGTTGATA
AATTTGGTCGTCGTAAGTGTCTATTGGGTGGTTCTGCTTCCATGGCCATTTGTTTTGTTA
TCTTCTCTACTGTCGGTGTCACAAGCTTATATCCAAATGGTAAAGATCAACCATCTTCCA
AGGCTGCCGGTAACGTCATGATTGTCTTTACCTGTTTATTCATTTTCTTCTTCGCTATTA
GTTGGGCCCCAATTGCCTACGTTATTGTTGCCGAATCCTATCCTTTGCGTGTCAAAAATC
GTGCTATGGCTATTGCTGTTGGTGCCAACTGGATTTGGGGTTTCTTGATTGGTTTCTTCA
CTCCCTTCATTACAAGTGCAATTGGATTTTCATACGGGTATGTCTTCATGGGCTGTTTGG
TATTTTCATTCTTCTACGTGTTTTTCTTTGTCTGTGAAACCAAGGGCTTAACATTAGAGG
AAGTTAATGAAATGTATGTTGAAGGTGTCAAACCATGGAAATCTGGTAGCTGGATCTCAA
AGAAAAAAGAGTTTCCGAGGAATAA

>YMR011W, 541 aa (SEQ ID NO 304)
MSEFATSRVESGSQQTSIHSTPIVQKLETDESPIQTKSEYTNAELPAKPIAAYWTVICLC
LMIAFGGFVFGWDTGTISGFVNQTDFKRRFGQMKSDGTYYLSDVRTGLIVGIFNIGCAFG
GLTLGRLGDMYGRRIGLMCVVLVYIVGIVIQIASSDKWYQYFIGRIISGMGVGGIAVLSP
TLISETAPKHIRGTCVSFYQLMITLGIFLGYCTNYGTKDYSNSVQWRVPLGLNFAFAIFM
IAGMLMVPESPRFLVEKGRYEDAKRSLAKSNKVTIEDPSIVAEMDTIMANVETERLAGNA
SWGELFSNKGAILPRVIMGIMIQSLQQLTGNNYFFYYGTTIFNAVGMKDSFQTSIVLGIV
NFASTFVALYTVDKFGRRKCLLGGSASMAICFVIFSTVGVTSLYPNGKDQPSSKAAGNVM
IVFTCLFIFFFAISWAPIAYVIVAESYPLRVKNRAMAIAVGANWIWGFLIGFFTPFITSA
IGFSYGYVFMGCLVFSFFYVFFFVCETKGLTLEEVNEMYVEGVKPWKSGSWISKEKRVSE
E

>YMR099C, 1394 bp, CDS: 501-1394 (SEQ ID NO 307)
AACAGTTCACCTCGATCTACATATATTTCAATGCGAGAATGATTAATTCTTGCCATTGAC
AAACAACCCTTTTACTGCCAGCGCCTTTCATAACCATGTAGTTTTATATGCCTAATTATA
ATAAAGCATGACATATAATGCCAACCCCATATTTATATAGTTAACTTGAAACCGAGATTC
ATCTATTGCACCAGGAAAAGTGCCTTCTTCTTAAAACATAAGTTACGTCCCGACCATTCA
TCTAAACGGCATCAATCATTGCAGCAGAAGAAATAGTGTGTAGATGTCCTCGTTCGCTAG
ACGCAGTCAATGATAACAAGGTCTTTCTTCAAGCTGTCTTTCCATAAAAAGGTATCGCAA
ATGGGGTCACCAATGCGCCTTTTATTTTTCACGCCGAAAGAAAACTTAGTAGGTCCCTAG
AAATGAATAAAGAGGTGATTCTGAGGTTCATTATAAGCCTTTGGTAAAACTTGAACCAAG
AAAGATTAAAACACAAAGCCATGCCTATCAAAGAAACTGATAAAGAAGTTGTTTTGACTC
ATCCAGCTGATGAGACCACCAGCGTTCATATTCTAAAGTACGGTGCTACAGTTTATTCTT
GGAAATTGAAATCTGAAGAACAGTTGTGGTTGTCTACTGCTGCTAAATTGGATGGTAGCA
AACCTGTGAGAGGTGGTATACCTTTGGTCTTTCCTGTATTCGGGAAAAATAGCACCGATG
AACATTTGAGTAAATTACCTCAACATGGTCTTGCAAGAAATTCTACTTGGGAGTTTTTGG
GTCAAACTAAGGAAAACCCACCGACCGTACAATTTGGCTTGAAACCAGAAATTGCTAACC
CAGAATTGACCAAATTGTGGCCAATGGATTATCTTTTGATTTTGACTGTTGAATTAGGCT
CCGATTATTTGAAAACTGCCATAGAAGTAGAAAACACATCTAGTTCCAAGGAATTAAAGT
TCAACTGGTTGTTCCATACATACTTCCGTATCGAAGATATTGAAGGAACAATGGTCTCTA
ATTTAGCTGGCATGAAACTTTATGACCAACTGTTGAAGGAATCCTACGTCGACAAGCACC
CAGTCGTTACCTTCAATCAAGAAACCGATGTAATTTATCAGAATGTCAGCGCCGAACGGG
CCATTCAAATAGTTGACAAGGGCGTTCAAATTCACACTCTAAAAGATACAACTTGCCCG
ACACTGTTGTTTGGAATCCATGGATTGAGAAGTCTCAAGGGATGGCCGATTTCGAACCAA

AAACTGGTTACCAACAAATGATATGTATTGAACCTGGTCATGTTCATGATTTTATTTCCT
TGGCTCCTGGTAAAAAATGGAATGCTTATCAATTACTTTGCAAAGAAGAATTGAAATATC
AAGCTATTCAATAA

>YMR099C, 297 aa (SEQ ID NO 308)
MPIKETDKEVVLTHPADETTSVHILKYGATVYSWKLKSEEQLWLSTAAKLDGSKPVRGGI
PLVFPVFGKNSTDEHLSKLPQHGLARNSTWEFLGQTKENPPTVQFGLKPEIANPELTKLW
PMDYLLILTVELGSDYLKTAIEVENTSSSKELKFNWLFHTYFRIEDIEGTMVSNLAGMKL
YDQLLKESYVDKHPVVTFNQETDVIYQNVSAERAIQIVDKGVQIHTLKRYNLPDTVVWNP
WIEKSQGMADFEPKTGYQQMICIEPGHVHDFISLAPGKKWNAYQLLCKEELKYQAIQ

>YMR110C, 2099 bp, CDS: 501-2099 (SEQ ID NO 311)
AAGAGAGAGAAGCTAGATTATCATTACAGCAGCCACATAGTATACCAAATTCCAGTACAG
GCACACCAGAACATGATCAAGACACTTAGAGGAAATGGAACAACGAATTTCCAGCCAAAA
ATTCCGAGTAGTTCATGATGAAAGATTTTTACATGCATTTTATATATAAATATATACCGT
CCTATATGGATTTCATGCCAACAGGGTATATAATAGACAATTACCGGTGTACTGATATAT
CAACTATCGACTCCAAGCCTTTTATCTATCAGTCAATTTTACATCAAGATCCCACTTTTA
GATAGGTTCGAAAATTCAATCTAATATTAGTGATTTAATTAGATGGTGGATTGCTTACCC
TTTTTTTTGTCGTTTTAGGAGGAGATTCTTCGGATTTTAGGGATAAACGGATACTCCATA
TATAAAAAACAAAACTTCAGGCATATTGATTATCTAAAAGGAATATTCTAAAACCATAGC
CATAGTAATTTATCACCAACATGTCAAACGACGGCTCAAAAATATTGAATTATACCCCAG
TGTCTAAAATAGATGAAATAGTTGAAATCTCAAGAAATTTCTTCTTTGAGAAACAATTGA
AATTGTCCCACGAAAATAACCCAAGGAAAAAGATCTAGAATTCAGGCAGTTGCAGTTGA
AAAAACTCTATTATGCCGTCAAAGATCATGAGGAAGAACTGATCGATGCTATGTACAAGG
ACTTTCATCGGAACAAAATTGAATCGGTTCTGAATGAAACGACCAAACTTATGAACGATA
TACTTCACCTAATTGAGATTTTACCAAAATTGATCAAACCTCGGAGAGTATCTGATTCTT
CTCCTCCATTTATGTTTGGTAAAACAATCGTGGAGAAAATATCAAGGGGCAGTGTCTTGA
TTATTGCTCCTTTCAATTTTCCCCTACTTTTAGCATTTGCCCCATTGGCAGCAGCTCTTG
CTGCAGGTAACACCATTGTTCTGAAGCCAAGTGAACTAACACCACACACTGCTGTAGTTA
TGGAAAATTTGTTAACCACAGCTGGTTTCCCTGATGGATTGATTCAAGTAGTTCAGGGAG
CTATAGATGAAACTACAAGACTACTAGATTGTGGAAAATTTGACCTAATATTCTACACAG
GTTCTCCCCGTGTCGGATCAATAGTTGCTGAGAAAGCAGCAAAAAGTCTAACACCTTGTG
TACTTGAACTTGGTGGTAAATCACCTACCTTTATTACAGAAAATTTCAAAGCAAGTAACA
TAAAAATTGCTTTGAAAAGGATTTTTTTGGTGCTTTCGGAAATTCTGGCCAGATTTGTG
TTTCACCAGATTATTTGTTAGTACATAAATCTATCTATCCAAAAGTCATTAAAGAGTGTG
AATCAGTACTAAATGAATTTTATCCAAGCTTTGATGAACAAACAGATTTCACTCGTATGA
TTCATGAGCCTGCTTACAAAAAGGCCGTTGCAAGTATAAACTCAACTAACGGCTCCAAGA
TTGTGCCTTCAAAAATTTCTATCAATTCAGATACTGAGGATCTATGCCTTGTACCACCAA
CCATAGTTTATAACATTGGTTGGGATGATCCTTTGATGAAACAGGAAAACTTTGCTCCTG
TATTGCCCATCATTGAGTACGAGGATCTTGATGAGACCATTAACAAGATAATAGAAGAAC
ATGACACTCCATTGGTGCAATACATATTCTCTGATAGCCAAACTGAAATAAATCGTATCT
TGACGCGCTTAAGATCTGGTGACTGTGTTGTCGGTGATACAGTGATTCATGTAGGAATTA
CCGACGCTCCATTTGGAGGGATCGGTACTTCAGGTTATGGTAACTATGGTGGATATTATG
GATTCAATACCTTTAGTCATGAAAGAACAATTTTTAAACAACCATATTGGAATGATTTTA
CCCTTTTTATGAGATACCCTCCAAATAGCGCACAAAAGGAAAGCTCGTCCGTTTTGCGA
TGGAAAGAAAACCTTGGTTTGACAGAAATGGCAATAACAAGTGGGGGTTACGCCAATATT
TTTCATTATCTGCCGCCGTTATTTTAATTAGTACCATTTACGCTCATTGTTCTTCCTGA

>YMR110C, 532 aa (SEQ ID NO 312)
MSNDGSKILNYTPVSKIDEIVEISRNFFFEKQLKLSHENNPRKKDLEFRQLQLKKLYYAV
KDHEEELIDAMYKDFHRNKIESVLNETTKLMNDILHLIEILPKLIKPRRVSDSSPPFMFG
KTIVEKISRGSVLIIAPFNFPLLLAFAPLAAALAAGNTIVLKPSELTPHTAVVMENLLTT

AGFPDGLIQVVQGAIDETTRLLDCGKFDLIFYTGSPRVGSIVAEKAAKSLTPCVLELGGK
SPTFITENFKASNIKIALKRIFFGAFGNSGQICVSPDYLLVHKSIYPKVIKECESVLNEF
YPSFDEQTDFTRMIHEPAYKKAVASINSTNGSKIVPSKISINSDTEDLCLVPPTIVYNIG
WDDPLMKQENFAPVLPIIEYEDLDETINKIIEEHDTPLVQYIFSDSQTEINRILTRLRSG
DCVVGDTVIHVGITDAPFGGIGTSGYGNYGGYYGFNTFSHERTIFKQPYWNDFTLFMRYP
PNSAQKEKLVRFAMERKPWFDRNGNNKWGLRQYFSLSAAVILISTIYAHCSS

>YMR173W-A, 1685 bp, CDS: 501-1685 (SEQ ID NO 691)
AAAAAACCACTCCGAAGGTTCGAGGATGACAAATCGCCCCTTAGCTGTGGCCATACAAGC
TTGGCACCGACGAAAAAGGGAAAAAGGAAAAGAATGTCGTACAAGAACTCTTACAACCAC
GTTGAGATTTCATTTAACAACGCCCCCCTTTCCATTATATAAGAAGGCATTAATTTTTAT
GTAATAAAAAAAGAATTTCTCGAAAATGTCTTACAATTAATTTTTTCTTTTGTAGAGTAG
GGCTTTAATAGACTGATATATACGGTATTATAAGTGAACGAAAAAAACAGCAATGGGTTT
ATTTGATAAAGTGAAGCAATTTGCTAACAGCAATAATAACAACAATGATTCTGGCAATAA
CAATCAAGGCGATTATGTTACCAAAGCTGAGAATATGATCGGCGAAGATAGAGTCAATCA
ATTCAAAAGCAAAATCGGAGAGGACAGATTTGATAAGATGGAGTCCAAGGTTCGTCAACA
ATTTTCTAATACCTCTATAAATGACAACGACTCCAACAACAACGACTCATATGGTTCTAA
TAACAACGATTCATATGGTTCTAACAACAATGATTCATATGGCTCTAACAACAATGATTC
ATATGGCTCCAACAACAATGATTCATATGGCTCTAACAACGATGATTCCTACGGTTCTTC
CAACAAGAAGAAGAGCTCTTATGGTTCTAACAATGACGATTCGTACGGCTCCAGCAACAA
CAATGACTCTTACGGTTCCAACAACAATGACTCTTACGGTTCCAACAACAATGACTCTTA
CGGTTCCAACAATGACGACTCTTACGGTTCGTCAAACAAGAATAAGAGCTCTTACGGTTC
CAACAATGACGATTCTTATGGCTCTAACAATGATGATTCATATGGTTCTTCCAACAAGAA
GAAGAGTTCTTATGGTTCCAGCAACAACGATTCGTATGGTTCTAACAACGATGATTCATA
TGGTTCTAACAACAATGATTCATATGGCTCTAACAACGATGATTCCTACGGTTCTTCCAA
CAAGAAGAAGAGCTCTTATGGTTCTAACAATGACGATTCGTACGGCTCCAGCAACAACAA
TGACTCTTACGGTTCCAACAATGACGACTCTTACGGTTCGTCAAACAAGAATAAGAGCTC
TTACGGTTCTTCTAGCAACGATGATTCTTACGGATCTTCCAATAACGACGACTCTTACGG
TTCTTCCAACAAGAAGAAGAGTTCTTATGGTTCCAACAATGACGATTCTTATGGCTCTAA
CAATGATGATTCATATGGTTCTTCCAACAAGAAGAAGAGTTCTTATGGTTCCAGCAACAA
CGATTCGTATGGTTCTAACAACGATGATTCCTACGGTTCTTCTAACAAAAAGAAGAGTTC
TTATGGTTCCAACAACGATGATTCATACGGCTCCAGCAACAACAATGACTCTTACGGTTC
CAACAATGACGACTCTTACGGTTCCTCTAATAGAAACAAGAACTCCTATGGGTCTTCCAA
CTACGGTTCATCCAACAATGATGACTCTTATGGTTCATCTAATAGAGGCGGTCGTAATCA
ATACGGTGGTGACGACGATTACTAAGTTTTTGGATGTCTTCGATAAAAAAAATATATTAT
TGTGTTTAGACTTAAGTATGAAAATTTTATGTATGAGCTGTGGCTATGTATCCGCTGGCA
AATAG

>YMR173W-A, 394 aa (SEQ ID NO 692)
MTTTPTTTTHMVLITTIHMVLTTMIHMALTTMIHMAPTTMIHMALTTMIPTVLPTRRRAL
MVLTMTIRTAPATTMTLTVPTTMTLTVPTTMTLTVPTMTTLTVRQTRIRALTVPTMTILM
ALTMMIHMVLPTRRRVLMVPATTIRMVLTTMIHMVLTTMIHMALTTMIPTVLPTRRRALM
VLTMTIRTAPATTMTLTVPTMTTLTVRQTRIRALTVLLATMILTDLPITTTLTVLPTRRR
VLMVPTMTILMALTMMIHMVLPTRRRVLMVPATTIRMVLTTMIPTVLLTKRRVLMVPTTM
IHTAPATTMTLTVPTMTTLTVPLIETRTPMGLPTTVHPTMMTLMVHLIEAVVINTVVTTI
TKFLDVFDKKNILLCLDLSMKILCMSCGYVSAGK

>YNL031C, 911 bp, CDS: 501-911 (SEQ ID NO 325)
CAACAGCCCAGGCGCGAGTGAACAACATATTAAATTAAACGCCTTCTTGTCAGTTGTTTT
GTTCTGGTCTGGTCTGCATTTCGCGCCCGAAAAAGCTTGAGACGCGAAGCTCCCAGAACG
TCCTGCCATACAAATGCGAAACTCTCGGTCTAGTACCACTTTCCCGGTGCCAAACGACCA
CAGTTGTCCGTTCCGAGCACTTCGCATTAAGCGCGTGAAACTATTGGCACGCCCTAAGGG
GCTCCTACGGATGGGAGTTGGTCATTTAGCGTTCATTATCGCCCAATGTGACGCACAATC
ACGGCTATGGCTCGGTGTCAAAACATAGTTTGCGTGATAACAGCGTGTTGTGCTCTCTCG
CGTTGCTTCTTGTGACCGCAGTTGTATATAAATAATCTTTTTCTTGTTCTTTTATATAGG
ACCACTGTTTTGTGACTTCCACTTTGGCCCTTCCAACTGTTCTTCCCCTTTTACTAAAGG

ATCCAAGCAAACACTCCACAATGGCCAGAACTAAACAAACAGCTAGAAAATCCACTGGTG
GTAAAGCCCCAAGAAAACAATTAGCCTCCAAGGCTGCCAGAAAATCCGCCCCATCTACCG
GTGGTGTTAAGAAGCCTCACAGATATAAGCCAGGTACTGTTGCCTTGAGAGAAATTAGAA
GATTCCAAAAATCTACTGAACTGTTGATCAGAAAGTTACCTTTCCAAAGATTGGTCAGAG
AAATCGCTCAAGATTTCAAGACCGACTTGAGATTTCAATCTTCTGCTATCGGTGCTTTGC
AAGAATCCGTCGAAGCATACTTAGTCTCTTTGTTTGAAGACACTAATCTGGCTGCTATTC
ACGCTAAGCGTGTTACTATCCAAAAGAAGGATATCAAATTGGCCAGAAGACTAAGAGGTG
AAAGATCATGA

>YNL031C, 136 aa (SEQ ID NO 326)
MARTKQTARKSTGGKAPRKQLASKAARKSAPSTGGVKKPHRYKPGTVALREIRRFQKSTE
LLIRKLPFQRLVREIAQDFKTDLRFQSSAIGALQESVEAYLVSLFEDTNLAAIHAKRVTI
QKKDIKLARRLRGERS

>YNL134C, 1631 bp, CDS: 501-1631 (SEQ ID NO 331)
AAACTCGGAAACTCTTTTTCTATTCATCTTCCCTTCTCGTACGTGCCCACGGAAGCAATA
AAAAGAACCGAAATAACCAACACCCGTAACGTCAAAGCATTCATGCTTAGAATGGAAACC
ATTTCGTGGAATGAAATGGCAAATTGATCACATTGATTGCTCGTTCCACTACCTGTGTCC
GCAATTTTTTAATGGTCATCACAGCCCCTGCTGACTAAAGTTCCTCGGATCCGCTTACGG
TTGTCGCGCGGTTCCGCCCCTGCGTACTCTTAGTACCTAGCATATGGGCTCCCTCCGTTG
GATTGGCATCGATTAGTAAGGACAGATGTTAAGGATTTAAGACCGTTTTTAAGGTATTTC
GGCAATGCTTCGATTTAAAAGGAGAGAGTTTTTTTTTGCCGTTTTCTTCCTCTCACTTC
TTGATTAGTACTGTAATTCTAGTTGAAAAAAAATCGTTAACTATACACAGCAAAAGCAA
TATCATACTGCATATCAAGCATGTCCGCCTCGATTCCAGAAACCATGAAAGCCGTTGTCA
TTGAAAATGGCAAGGCTGTAGTCAAACAGGACATTCCAATTCCTGAATTAGAAGAAGGAT
TTGTTCTAATTAAGACTGTCGCCGTTGCCGGTAACCCTACCGATTGGAAACATATTGATT
TCAAGATTGGTCCTCAAGGTGCCCTCTTAGGCTGTGATGCAGCCGGCCAAATCGTAAAGT
TGGGCCCAAATGTTGATGCTGCACGCTTTGCCATTGGTGATTACATTTATGGGGTTATTC
ACGGTGCTTCAGTGAGGTTCCCCTCAAACGGTGCCTTTGCTGAGTACTCTGCCATTTCAT
CCGAGACTGCTTATAAACCAGCCAGAGAGTTTAGATTGTGCGGTAAAGACAAGCTACCAG
AAGGCCCCGTAAAATCTTTAGAAGGGGCAGTATCCCTCCCAGTCTCATTGACCACGGCTG
GTATGATCCTTACACATAGTTTTGGCTTGGACATGACATGGAAGCCCTCCAAAGCGCAAA
GAGATCAACCCATCTTATTTTGGGGTGGTGCCACTGCTGTTGGCCAGATGCTTATTCAAT
TGGCAAAAAAACTAAACGGTTTCAGCAAGATCATCGTCGTTGCTTCTCGTAAACATGAAA
AATTGTTGAAAGAGTACGGTGCAGATGAACTTTTTGACTACCACGATGCTGACGTTATCG
AACAGATAAAAAAGAAGTACAACAACATTCCTTACTTGGTGGACTGTGTCTCCAACACAG
AAACTATTCAACAGGTGTACAAATGTGCCGCTGATGACTTAGACGCTACGGTCGTTCAAT
TGACCGTTTTAACCGAAAAAGATATCAAGGAGGAAGACAGGAGGCAAAACGTCAGTATTG
AAGGAACCCTTCTATATTTGATAGGAGGTAACGACGTCCCATTTGGCACGTTTACTTTGC
CAGCAGACCCTGAATACAAGGAAGCCGCCATAAAATTTATTAAGTTCATCAATCCAAAAA
TCAATGATGGTGAAATCCACCACATCCCAGTGAAAGTTTACAAGAACGGGTTAGATGATA
TCCCACAGTTACTTGATGATATTAAGCACGGGAGGAATTCTGGCGAAAAGTTGGTTGCCG
TCTTGAAATAA

>YNL134C, 376 aa (SEQ ID NO 332)
MSASIPETMKAVVIENGKAVVKQDIPIPELEEGFVLIKTVAVAGNPTDWKHIDFKIGPQG
ALLGCDAAGQIVKLGPNVDAARFAIGDYIYGVIHGASVRFPSNGAFAEYSAISSETAYKP
AREFRLCGKDKLPEGPVKSLEGAVSLPVSLTTAGMILTHSFGLDMTWKPSKAQRDQPILF
WGGATAVGQMLIQLAKKLNGFSKIIVVASRKHEKLLKEYGADELFDYHDADVIEQIKKKY
NNIPYLVDCVSNTETIQQVYKCAADDLDATVVQLTVLTEKDIKEEDRRQNVSIEGTLLYL
IGGNDVPFGTFTLPADPEYKEAAIKFIKFINPKINDGEIHHIPVKVYKNGLDDIPQLLDD
IKHGRNSGEKLVAVLK

>YNR002C, 1349 bp, CDS: 501-1349 (SEQ ID NO 339)
ATGGACAATTTGAAGTTCTTGACTACCCCTATCTCACACTAGTACGTAATTCAATGTATC
ATTCGTATTGTAAGTAGATAGAGACGCAATACAGGAAAGCTGACCTTCCTTCCAATCACC

ACGGCTGAAATGCTTTGTTGACCAATTACGGACGCTTAAGAGCGGACGCGGCTGGAACGG
CTCCATCCTAAATCGGCGGAGGGAGAACTCCGATACCAGCCGACATGGCAATAATAGTGA
CAGTAGATGCTACCAGCCCCGCAATAATTTCACAGTAGATCATCAACAGTCTCCTCATTT
CTGGAAATGATCAGCAACTTCGACGGATTTAACTCTCAAGCAGTTACGCACTCCGAGAAC
AGCCGTGATCATCTTTGAACAAGCAAAATATATAAAGCAGGAGAACTGTCCTACCTAGAG
CTAGAATAGCCATAACTAACTATGTAACATTCTACAGATCAATCAAAAACAATCTTCAAT
CACAGAAAAAATAAAAGGCATGTCTGACAGAGAACAAAGCAGCGGCAACACCGCTTTTG
AGAACCCTAAGGCACTCGATTCTTCCGAGGGTGAGTTCATCTCTGAAAACAACGATCAGA
GCCGCCACTCGCAAGAGTCCATATGCAAAATATATACTGCGGGCAAAAACAACGAGTATA
TTTACATCGGCCGTCAAAAATTTTAAGGGATGATTTGTTCGAGGCATTCGGTGGTACTC
TGAATCCCGGTTTAGCCCCCGCGCCAGTCCATAAATTCGCAAATCCTGCTCCACTAGGAC
TTTCCGGTTTTGCCCTCACTACGTTTGTCCTATCCATGTTCAATGCAAGAGCCCAAGGCA
TCACTATCCCTAATGTTGTTGTTGGGTGTGCCATGTTTTACGGTGGCCTCGTTCAACTCA
TTGCTGGTATTTGGGAAATCGCTTTAGAGAACACTTTCGGTGGTACAGCCCTGTGTTCCT
TCGGCGGTTTTTGGTTAAGCTTCGGTGCTATATACATCCCTTGGTTTGGAATTCTAGATG
CCTATAAGGACAAGGAATCCGACCTTGGAAATGCGCTAGGGTTTTACCTCCTAGGATGGG
CACTCTTCACCTTCGGTCTTTCCGTCTGCACCATGAAATCAACTATAATGTTTTTTGCCT
TATTCTTCCTCTTAGCAGTGACCTTCTTACTTCTATCCATTGCAAACTTCACAGGCGAAG
TTGGCGTCACTAGAGCTGGTGGGGTCCTTGGTGTGATAGTAGCCTTCATTGCCTGGTACA
ACGCTTACGCAGGTATTGCCACAAGACAAAACTCGTACATTATGGTCCATCCATTCGCAT
TACCTAGCAATGATAAGGTGTTCTTCTAA

>YNR002C, 282 aa (SEQ ID NO 340)
MSDREQSSGNTAFENPKALDSSEGEFISENNDQSRHSQESICKIYTAGKNNEYIYIGRQK
FLRDDLFEAFGGTLNPGLAPAPVHKFANPAPLGLSGFALTTFVLSMFNARAQGITIPNVV
VGCAMFYGGLVQLIAGIWEIALENTFGGTALCSFGGFWLSFGAIYIPWFGILDAYKDKES
DLGNALGFYLLGWALFTFGLSVCTMKSTIMFFALFFLLAVTFLLLSIANFTGEVGVTRAG
GVLGVIVAFIAWYNAYAGIATRQNSYIMVHPFALPSNDKVFF

>YOL139C, 1142 bp, CDS: 501-1142 (SEQ ID NO 347)
ACAAGTTTGGATACTGGTATTGTGACTCTTGTAAGAAGAAGAATACATCTTGTGTTCTAT
GTGAAAGACCATTAAAGAAACTGACCATGGTCATCCTCCCCTGTGGACACGAAGGTCACT
TCCAGTGCATACAAGAATGGTTTCTCGATGAGAATGAACAAGAATGTCCCGGCGGTTGCC
CCGGTGTTGCATTCATCTAGGTTCTCCACATAATGTATAGTTTAACATATCATCACCATT
GTTTAGTTAAATCGTTTAGAGTAATATTACCCGTCAAAAAGGTCGGGTAAAATTTTATTA
CCCTCTCCGAAAAGAAAATTTTTTTCGTCGTCAATAGAGTTTAATGCAATACCTGATAAA
GAGAGTTTTACATTGCAAGAGGTAGTGTTAATTCTGGATTTATATTGTACATATGTGTTT
GTGTTAGTGCTTGAGTACTTCCTAGGAGTTTTACGAAAAATAAAAGCATTTTGTCTGAA
AACTAGTGAAAGGAAGAAAAATGTCCGTTGAAGAAGTTAGCAAGAAGTTTGAAGAAACG
TTTCAGTCGATGATACCACAGCTACTCCAAAGACTGTTTTAAGTGACAGTGCTCACTTCG
ATGTCAAGCACCCATTGAACACCAAATGGACTTTATGGTACACAAAGCCAGCCGTCGATA
AATCTGAGTCGTGGTCTGATCTATTACGTCCCGTCACTTCATTCCAAACTGTTGAAGAAT
TTTGGGCTATCATTCAAAATATTCCTGAGCCACACGAACTACCATTGAAATCAGATTACC
ACGTCTTCCGTAATGACGTTAGACCTGAATGGGAAGATGAAGCCAATGCTAAAGGTGGTA
AATGGTCTTTCCAACTTAGAGGAAAAGGTGCTGATATTGATGAATTATGGCTAAGAACTT
TACTAGCAGTTATTGGTGAAACAATTGATGAAGACGACTCCCAAATTAACGGTGTCGTTT
TAAGCATTAGAAAAGGTGGTAACAAGTTTGCCTTATGGACTAAATCTGAAGACAAAGAAC
CACTATTGAGAATTGGTGGTAAATTCAAGCAAGTTTTAAAATTAACCGATGACGGGCATT
TGGAATTCTTTCCACATTCCAGTGCCAATGGTAGACACCCTCAACCATCAATCACCTTGT
AA

>YOL139C, 213 aa (SEQ ID NO 348)
MSVEEVSKKFEENVSVDDTTATPKTVLSDSAHFDVKHPLNTKWTLWYTKPAVDKSESWSD
LLRPVTSFQTVEEFWAIIQNIPEPHELPLKSDYHVFRNDVRPEWEDEANAKGGKWSFQLR
GKGADIDELWLRTLLAVIGETIDEDDSQINGVVLSIRKGGNKFALWTKSEDKEPLLRIGG
KFKQVLKLTDDGHLEFFPHSSANGRHPQPSITL

>YOR120W, 1439 bp, CDS: 501-1439 (SEQ ID NO 353)
TGTCTTACATATTGCAATGGATATGCTTGGGTGATCATACTTCCTGGCTTTAGATATTTG
AAACTTAACTCTTGTCAACAAACTTCCTATGGAGTGTATAAGAATTGTAAGTTATAACAC
CGGCGAACAATCGGGGCAGACTATTCCGGGGAAGAACAAGGAAGGGCGGTCTTTTCTCCC
TCATTGTCATAGCAAGGTCATTTCGCCTTCTCAGAAAGGGGTAGAATCAATCTAGCACGC
AGATTGCAAACACGGCTTAATAATATGCCTATCAGGCATTCACCCGTGTGACGAATCGCA
CACCGCTGCTCTCCTTAATTCCCTAGAGTAGAAACCGAGCTTTCAGGAAAAGACTACGGC
AGTAAAGAATTGCTTTACTGGGCGTATAAAACCGGGAGAATCAAGACATTCTAATGACTT
GATTCAGGATGAGAGCTTAATAGGTGCATCTTAGCAAGCTAAAATTTGGACAGCTCTCAT
TACTAAATTAAGATAGAAAAATGCCTGCTACTTTACATGATTCTACGAAAATCCTTTCTC
TAAATACTGGAGCCCAAATCCCTCAAATAGGTTTAGGTACGTGGCAGTCGAAAGAGAACG
ATGCTTATAAGGCTGTTTTAACCGCTTTGAAAGATGGCTACCGACACATTGATACTGCTG
CTATTTACCGTAATGAAGACCAAGTCGGTCAAGCCATCAAGGATTCAGGTGTTCCTCGGG
AAGAAATCTTTGTTACTACAAAGTTATGGTGTACACAACACCACGAACCTGAAGTAGCGC
TGGATCAATCACTAAAGAGGTTAGGATTGGACTACGTAGACTTATATTTGATGCATTGGC
CTGCCAGATTAGATCCAGCCTACATCAAAAATGAAGACATCTTGAGTGTGCCAACAAAGA
AGGATGGTTCTCGTGCAGTGGATATCACCAATTGGAATTTCATCAAAACCTGGGAATTAA
TGCAGGAACTACCAAAGACTGGTAAAACTAAGGCCGTTGGAGTCTCCAACTTTTCTATAA
ATAACCTGAAAGATCTATTAGCATCTCAAGGTAATAAGCTTACGCCAGCTGCTAACCAAG
TCGAAATACATCCATTACTACCTCAAGACGAATTGATTAATTTTTGTAAAAGTAAAGGCA
TTGTGGTTGAAGCTTATTCTCCGTTAGGTAGTACCGATGCTCCACTATTGAAGGAACCGG
TTATCCTTGAAATTGCGAAGAAAAATAACGTTCAACCCGGACACGTTGTTATTAGCTGGC
ACGTCCAAAGAGGTTATGTTGTCTTGCCAAAATCTGTGAATCCCGATCGAATCAAAACGA
ACAGGAAAATATTTACTTTGTCTACTGAGGACTTTGAAGCTATCAATAACATATCGAAGG
AAAAGGGCGAAAAAGGGTTGTACATCCAAATTGGTCTCCTTTCGAAGTATTCAAGTAA

>YOR120W, 312 aa (SEQ ID NO 354)
MPATLHDSTKILSLNTGAQIPQIGLGTWQSKENDAYKAVLTALKDGYRHIDTAAIYRNED
QVGQAIKDSGVPREEIFVTTKLWCTQHHEPEVALDQSLKRLGLDYVDLYLMHWPARLDPA
YIKNEDILSVPTKKDGSRAVDITNWNFIKTWELMQELPKTGKTKAVGVSNFSINNLKDLL
ASQGNKLTPAANQVEIHPLLPQDELINFCKSKGIVVEAYSPLGSTDAPLLKEPVILEIAK
KNNVQPGHVVISWHVQRGYVVLPKSVNPDRIKTNRKIFTLSTEDFEAINNISKEKGEKRV
VHPNWSPFEVFK

>YOR122C, 1090 bp, exon1 : 501-513, intron1: 514-722, exon2: 723-1090 (SEQ ID NO 357)
AGGAAGAGGAGGCTGCGTTTGACGACGAAGAGGATGATAATGAGGAAGAAGAAGAAGAAG
AGGACGCGGATGAAGAGAACGCCTCTCGTCTAAGAAATTTAAAAAGAGAAGGAGCAGCAA
TGTACAGAGAAGAGGAAGAAGAAGAAAAAGATAGGAGCGAGACAAAAAGAAGAAGGGTTG
CGGTCATCGAGGACGACGAAGACGAGGATTAGAGGAGACGTTACTTTGTTTATATATATT
AGTATGTACAATCGCAAAGAAATGGAGTGATGACATGTTGTAGTATTTAGTATGAGGTTA
CTGTGTGGGAGGTTTTACCATGATTTTTGGCGAGAACACGCCATGAAATGTCTTTGTACG
AAACTCATTACCCGCATTAATATTTTTTTCTTTTTAAAGCTCAGTTGACCCTTTCTCAT
TCCCTTCTTAAAACAACTGTGTGATCCTTGAGAAAAGATAAATTACATACACAACATAAA
CCCAACTACGATCGCAAATTATGTCTTGGCAAGGTATGTGAACGAGACAATTATCAATTG
ATTAAGAAAGAAATGAGTCGGAGGTTAGCTTGTGTGACAATGTTTGGCAATGCCCGATTT
TTGTTGATGCGCGTAATTTCGAAGATTAACCACTCAGAGTAAATTACTAACTGGAATATC
AAAAAACATATGAAATTTCAAACATGAATTTCTTTCCGTTTTTTCTCCTACTTTTAAAC
AGCATACACTGATAACTTAATAGGAACCGGTAAAGTCGACAAAGCTGTCATCTACTCGAG
AGCAGGTGACGCTGTTTGGGCTACTTCTGGTGGCCTATCTTTGCAACCAAACGAAATTGG
TGAAATTGTTCAAGGCTTCGACAATCCAGCTGGTTTGCAAAGCAATGGTTTGCATATTCA
AGGCCAAAAGTTCATGTTGTTGAGAGCTGACGATAGAAGTATCTACGGTAGACATGATGC
TGAGGGTGTTGTTTGTGTAAGAACTAAGCAAACCGTTATTATTGCTCATTATCCACCAAC
CGTACAAGCCGGTGAGGCCACCAAGATTGTCGAGCAATTGGCTGACTACTTGATTGGTGT
TCAATACTAA >YOR122C, 126 aa (SEQ ID NO 358)
MSWQAYTDNLIGTGKVDKAVIYSRAGDAVWATSGGLSLQPNEIGEIVQGFDNPAGLQSNG
LHIQGQKFMLLRADDRSIYGRHDAEGVVCVRTKQTVIIAHYPPTVQAGEATKIVEQLADY
LIGVQY >YOR261C, 1517 bp, CDS: 501-1517 (SEQ ID NO 361)
GTAAGGTAAGGCATCATTAGCAGGATCCATATTCACTACCTGGGAATGTCTTCCGATGGC
ATTGAAGAACTGTGAGCAGCCGTTGCAATAGGTTGACTTCCCTGAACCTGGTGGACCAAT
AACAATCTGAGCGAAGGGCATTATTGTACTCTCTAGTAGAAAATCAAAACTATTGACACA
ACAACAATCAAATGAAAACAAACCATTCTATTACGGTAAGTAGTGAAGACTCACAATGCA
ATCTTTCAATGAGCATCACTTACTTTAAGTAGCAATATTCCTAATCACTTATTACGAAAT
TTGATTTTACTAAAGTTCGGGGATACCTCAGTGGCAAATCGTTACTCAAGTTGCACGTAA
CGTAGAATCTACAATGAAATAATTGTGAAGCCAACAGCTAAGCAATCTATAGTGTAACGT
TGGCTTTCTGTACAACTGCTACTGATTGAGGGCATTTTCGAATTTAAAAAAGAAAGAAA
GAAAGGAAAATCAAATTACAATGTCTCTACAACACGAGAAAGTTACCATTGCACCACTAG
TTTTGCTATCTGCTTTGGATCATTATGAGCGTACGCAGACAAAAGAAAACAAAAGATGCG
TTGGTGTCATCTTAGGTGATGCTAACAGTTCCACTATCAGAGTCACTAATTCCTTTGCCT
TACCGTTTGAAGAAGATGAGAAAAACTCTGACGTGTGGTTTTTAGACCATAATTATATTG
AAAACATGAATGAAATGTGTAAAAGATTAATGCCAAGGAAAAACTCATTGGATGGTATC
ATAGTGGTCCTAAATTAAGGGCTTCTGACCTCAAGATTAATGAGCTGTTTAAAAAATATA
CTCAGAATAATCCGCTATTATTAATTGTTGATGTCAAACAACAAGGTGTTGGTTTACCAA
CAGATGCATATGTCGCGATTGAGCAAGTTAAGGATGATGGTACGTCTACAGAAAAGACGT
TTCTTCATTTGCCTTGTACTATTGAGGCCGAAGAAGCTGAAGAAATTGGTGTAGAACACT
TATTGAGAGACGTACGTGATCAAGCAGCAGGTGGCTTATCTATCCGGTTGACCAACCAAT
TAAAATCTTTGAAAGGATTACAAAGCAAACTAAAAGACGTTGTCGAGTACTTAGACAAAG
TCATTAATAAGGAATTACCGATAAACCACACTATATTGGGCAAGCTACAAGATGTTTTCA
ACCTTTTACCAAATCTGGGAACACCTGATGATGACGAAATAGATGTGGAGAATCATGACA
GAATTAATATTTCAAATAACTTACAAAAGGCTTTAACTGTGAAAACTAATGATGAATTAA
TGGTTATATATATAAGCAATTTGGTTAGGTCAATTATCGCGTTTGATGATTTGATTGAAA
ACAAAATTCAAAATAAAAAAATTCAAGAACAAAGAGTAAAGGACAAACAATCAAAAGTCT
CTGATGACAGTGAGAGTGAGAGTGGTGACAAAGAAGCAACTGCGCCATTGATCCAACGAA
AGAACAAGAAAAATTAA >YOR261C, 338 aa (SEQ ID NO 362)
MSLQHEKVTIAPLVLLSALDHYERTQTKENKRCVGVILGDANSSTIRVTNSFALPFEEDE
KNSDVWFLDHNYIENMNEMCKKINAKEKLIGWYHSGPKLRASDLKINELFKKYTQNNPLL
LIVDVKQQGVGLPTDAYVAIEQVKDDGTSTEKTFLHLPCTIEAEEAEEIGVEHLLRDVRD
QAAGGLSIRLTNQLKSLKGLQSKLKDVVEYLDKVINKELPINHTILGKLQDVFNLLPNLG
TPDDDEIDVENHDRINISNNLQKALTVKTNDELMVIYISNLVRSIIAFDDLIENKIQNKK
IQEQRVKDKQSKVSDDSESESGDKEATAPLIQRKNKKN >YPL271W, 689 bp, CDS: 501-689 (SEQ ID NO 391)
CAGCAGCGACAAGTCAGAGTGCTTACAAAAAAAAAGAGTTGATCCGGCTAAAGAAAGTC
TGATTTACGTATTTATCCAGGTTCAAACGGATTGCCAAAAATAGTCGATAACCTCGGAGT
AAGCAAAGCAACAATATATTTGTTCTTCGAAAAGGTAAACTTCTTAACTTCTATAGAAGC
ATTGTACTAGTTCTCTCGAAGAAAAAAACTAAGAAAGCTATAGCTGTATCTTACCAAGCC
ATGAACTTGAGGAATTGGTAATCCTTATTAGGAAATACGCTAAACTAGGTAATAGCAGAT
GATTTACTAGCTTACTATCTCACACTAAGTCTGGCAACGCGCTTATTTTTAATACTTTT
ATACGAACCAATGAAATTTGATCCTCCCCTTTTCGTCTAGTTAAATGAAGAGATACAAG
TAGGCCTTTCTATTGAGTACTTAGCAAGATATGTATTTCTAAGAAACATCAACAGTTTCA
GCCCACAACCGATTCATAAAATGTCTGCCTGGAGGAAAGCTGGTATATCATATGCTGCAT
ATTTGAATGTGGCCGCTCAGGCTATCCGTTCTTCATTGAAAACTGAATTACAAACCGCTA
GTGTTCTTAACAGATCGCAAACAGATGCTTTTTATACCCAATATAAAAATGGCACTGCAG
CTTCTGAACCCACTCCAATAACAAAATAG >YPL271W, 62 aa (SEQ ID NO 392)
MSAWRKAGISYAAYLNVAAQAIRSSLKTELQTASVLNRSQTDAFYTQYKNGTAASEPTPI
TK >YPR035W, 1613 bp, CDS: 501-1613 (SEQ ID NO 395)
TAGTGCCATTTGTGGTCATTATTATTCCCCAAATATGCGAAAATAGTACACTATTTTTGG
CAGGAGAGTAGGCTGATATGCCGCATTGATGTCCTGTGTAGCGAAACACAAACAAAAAAA
GAAAAAGTAGGATGAAAAAAAGAAAAGTAATATGAAAAAAGAGTGAAAAATTAATTCATT
TGTTAGTGTAAGCGGTCAGGTGTAAGTAGTAGGCTTGATAATGAATTAAAGATGACTCCG
ACGCATATTGTTTGCCATGTTTTTATTTTAGTTTGTAGATTTCTTTTTTTGTAATATATA
AGGGAGTGATTCTATATATCGAATTCTCAGGCTTGGTTGGTTCGTAGGTTGTTCTGTCTT
TGTTTTCGTTAGGTAAGAACATCACACAAAGATAACTATAGAATCACATACATATTTGTG
AGAAATTAACTTCATTTCATTTATAGAAGAAGTTCAACCGAAACAAAAATTAAACATAAT
ATAATATAATATAATCAAAAATGGCTGAAGCAAGCATCGAAAAGACTCAAATTTTACAAA
AATATCTAGAACTGGACCAAGAGGTAGAATAATTGCCGAATACGTTTGGATCGATGGTA
CTGGTAACTTACGTTCCAAAGGTAGAACTTTGAAGAAGAGAATCACATCCATTGACCAAT
TGCCAGAATGGAACTTCGACGGTTCTTCTACCAACCAAGCGCCAGGCCACGACTCTGACA
TCTATTTGAAACCCGTTGCTTACTACCCAGATCCCTTCAGGAGAGGTGACAACATTGTTG
TCTTGGCCGCATGTTACAACAATGACGGTACTCCAAACAAGTTCAACCACAGACACGAAG
CTGCCAAGCTATTTGCTGCTCATAAGGATGAAGAAATCTGGTTTGGTCTAGAACAAGAAT
ACACTCTATTTGACATGTATGACGATGTTTACGGATGGCCAAAGGGTGGGTACCCAGCTC
CACAAGGTCCTTACTACTGTGGTGTTGGTGCCGGTAAGGTTTATGCCAGAGACATGATCG
AAGCTCACTACAGAGCTTGTTTGTATGCCGGATTAGAAATTTCTGGTATTAACGCTGAAG
TCATGCCATCTCAATGGGAATTCCAAGTCGGTCCATGTACCGGTATTGACATGGGTGACC
AATTATGGATGGCCAGATACTTTTTGCACAGAGTGGCAGAAGAGTTTGGTATCAAGATCT
CATTCCATCCAAAGCCATTGAAGGGTGACTGGAACGGTGCCGGTTGTCACGCTAACGTTT
CCACCAAGGAAATGAGACAACCAGGTGGTACGAAATACATCGAACAAGCCATCGAGAAGT
TATCCAAGAGACACGCTGAACACATTAAGTTGTACGGTAGCGATAACGACATGAGATTAA
CTGGTAGACATGAAACCGCTTCCATGACTGCCTTTTCTTCTGGTGTCGCCAACAGAGGTA
GCTCAATTAGAATCCCAAGATCCGTCGCCAAGGAAGGTTACGGTTACTTTGAAGACCGTA
GACCAGCTTCCAACATCGACCCATACTTGGTTACAGGTATCATGTGTGAAACTGTTTGCG
GTGCTATTGACAATGCTGACATGACGAAGGAATTTGAAAGAGAATCTTCATAA >YPR035W, 370 aa (SEQ ID NO 396)
MAEASIEKTQILQKYLELDQRGRIIAEYVWIDGTGNLRSKGRTLKKRITSIDQLPEWNFD
GSSTNQAPGHDSDIYLKPVAYYPDPFRRGDNIVVLAACYNNDGTPNKFNHRHEAAKLFAA
HKDEEIWFGLEQEYTLFDMYDDVYGWPKGGYPAPQGPYYCGVGAGKVYARDMIEAHYRAC
LYAGLEISGINAEVMPSQWEFQVGPCTGIDMGDQLWMARYFLHRVAEEFGIKISFHPKPL
KGDWNGAGCHANVSTKEMRQPGGTKYIEQAIEKLSKRHAEHIKLYGSDNDMRLTGRHETA
SMTAFSSGVANRGSSIRIPRSVAKEGYGYFEDRRPASNIDPYLVTGIMCETVCGAIDNAD
MTKEFERESS YBR133C, 2984 bp, CDS: 501-2984 (SEQ ID NO 53)
AACTTACGACAGAGTTGTAATGAATGCTACTGATGTCTGCTCTACTGCCA
TCCGCTGTCCTTTCATGCATAAAAGCTCCATTCTTTATTTATCTCATACC
ACGAGAAAAAAAATCACCTGACATATTTTTATAACCCGCCTTTTAGACC
CTAAAACAGATCTCAGGGCTCGAGTACTGTTTTATCTGAAAATTCTTCGA
GCCCTCGTTTTGCACTGAGCTAAACCAAAAGAAAAATAAACAATCACAAA
TGGAACCCGAAACAGCACGCTGCGCAGTGTTTTATATTTTTTGAAACA
AATGGCTTTATACAATGTGTATGTGTGATAGAAAAAATGGTATATTTCGA
GTGACTTGTGATCCTATTCCCAAGCCCTATAGGAGCTATTTCAAATTGCG
TGTGTGAAAGCGTGTGTGTGTGTGTGTGTGGAATTGTGCGGACGTTCC
TCTTCTTTTATACATATAATTTTTATATATACAAAGGGTTCAGTTTGCAT
ATGCATAGCAACGTATTTGTTGGTGTCAAACCAGGCTTTAATCATAAACA
GCACAGCAAAAAGTCACGTTTCCTAGAAAATGTCTCTAGTCATTCACCAG

```
AACTGCCTAGTAACTATGATTACGTTTTGCTTCCTATAACAACGCCAAGA
TATAAGGAAATAGTTGGGCAAGTTTTCAAAGATTTCCAAAGACAATCCAT
ACAGAACTGGAAACCGCTTCAAATTCCTGAACCGCAGTTGCAGGATATCT
GTATACCCCGTTCAACGTCAAGAAGCTAGACAATGACGATACGCCGTCT
TACATAGGGCTGTTATCCTCTTGGCTGGAGCTGGAGAGTCGCGATCCAAA
TGTAAGAGATCTTGGCTTAAAGGTCCTTCTAAACGAATGTAAGTACGCGA
GGTTTGTTGGAATCAATAAGCTAATATTGGCGCCTCCACGGGACCTGTCC
AACCTGCAATTGTATGGACAGATGATTTACAGGCTCCTGCAAAATCGCAT
CGTCTTTGCTGCGCCTGCGTTAACCATATCCATTTCTCTGCCACTTTACG
AAGACAGCGATCCATTGGCCACTTGGGAACTGTGGAATACCGTGCGGAAA
CAATGCGAATATCATCCCTCTTTGACTATCTCTTTGGCTTTGCCAAGAAC
CAGGACTCCTTCGTATGTGCTGAATAGATGGTTAGCCGAACCCGTCTCGT
GTCTTTTGGTATCTTCATCCATCTTTGCCAGTAATCAGTACGATTATCCC
GTTTTACACAAGTTTAACCAGAATTTGATTTTAAAGTTCCAAAAGGTTAA
TGGAGATTCACAAATTTTGGGTAATGAATTATGCGTGATATTGCATGGGA
TGGAGAAATATGCCAATAATGTTAAGGGCGGAGAATCTGCCTATTTGGAA
TATATAAACTACTTATTGAAAAAGGGCGACAAAGTATTAAATTCCAATAG
TAATCACCAATTTTTGCTCCAAGAGGACTCTCGGATAATGCCGCCTCTGA
AACCTCATTCAGATAATTTATTAAATTCCACATATTTGACTTTTGAAAAA
GATTTGGTGAAGTACGATCTTTACGAATCTGCCATATTAGAGGCGCTTCA
AGATCTTGCTCCTCGAGCGAGTGCCAAGAGACCGTTGGTGATCCTAGTAG
CCGGTGCGGGAAGAGGACCTTTAGTGGATCGAACTTTTAAGATAATATCA
ATGTTGTTTATGGATAGTAAGGTTTCTATAATTGCCATTGAAAAAAATCC
ACAGGCATATCTGTACTTGCAAAAAAGAAATTTCGACTGTTGGGATAATA
GAGTGAAATTAATCAAGGAGGATATGACCAAATGGCAAATCAACGAGCCG
TCGGAAAAGCGTATTCAGATAGATCTGTGCATAAGTGAACTGCTGGGTTC
GTTCGGTTGCAATGAATTATCACCAGAATGTCTCTGGTCTATTGAAAAAT
ATCATTCCCACAATGACACAATTTTCATACCGAGGTCATACTCTTCATAC
ATAGCACCCATTTCGTCACCATTATTCTACCAAAAACTCTCACAAACAAA
TCGCTCTTTGGAGGCGCCCTGGATAGTCCATAGAGTGCCATACTGTATAT
TATCCTCAAGGGTAAATGAAGTGTGGCGGTCGAGCATCCCATGGCCCAA
AAAGATACTGTCCAAGACGAAGATGATTTTACAGTTGAATTTTCTCAAAG
TTCATTAAATGAGTTCAAGATAAAGCACCGCGGCGAAATCCATGGCTTTA
TCGGATTCTTCTCGGCAAACTTATATAACAATATATTCTTGTCAACTTTG
CCCAATGACAGCACAGTCCGTTTAAAATTTAGCGAAGAAACGTTGATGAA
TACCAGACGAGAAGAAAATCTAATCAAGAAATGTGACCATACACCAAATA
TGACCTCGTGGTCTCCAATTATCTTTCCTTTGAAGCAACCAATATCCTTT
ATAGATGACTCCGAACTTTCTGTGCTGATGTCTCGGATACACTCCGATAC
AGAACAAAAAGTTTGGTATGAATGGTCTTTGGAGAGTTTCATATACCTTA
TGTTGTCAAATTACACTTCGGCGGTAACTGCTGCAAGCATGACTATTCCG
AGGTCTATAGTTACAGATGACACTAAAACTTTAGCCCATAATCGACATTA
TTCAGCGACTACCAATCAAAGCTAGATAATCAAATTGATCTTGACCAAG
ACATTGAAAACGAAGAAGAACAGGGATTCCTATCCAATCTAGAAACTGGT
TGGCAAAGCGTACAAGATATTCACGGACTCAGCGAAACCGCCAAACCGGA
CCATTTAGATTCTATCAATAAGCCTATGTTTGATCTCAAATCTACTAAAG
CGCTTGAACCCTCTAACGAATTGCCAAGGCACGAAGACCTCGAGGAAGAT
GTTCCAGAAGTTCATGTCAGAGTCAAGACTAGTGTTTCCACGCTACATAA
TGTCTGTGGCAGAGCCTTTTCCCTGCCTCTGTGA
```

YBR133C, 827 aa (SEQ ID NO 54)
MHSNVFVGVKPGFNHKQHSKKSRFLENVSSHSPELPSNYDYVLLPITTPR
YKEIVGQVFKDFQRQSIQNWKPLQIPEPQLDICIPPFNVKKLDNDDTPS
YIGLLSSWLELESRDPNVRDLGLKVLLNECKYARFVGINKLILAPPRDLS
NLQLYGQMIYRLLQNRIVFAAPALTISISLPLYEDSDPLATWELWNTVRK
QCEYHPSLTISLALPRTRTPSYVLNRWLAEPVSCLLVSSSIFASNQYDYP
VLHKFNQNLILKFQKVNGDSQILGNELCVILHGMEKYANNVKGGESAYLE

YINYLLKKGDKVLNSNSNHQFLLQEDSRIMPPLKPHSDNLLNSTYLTFEK
DLVKYDLYESAILEALQDLAPRASAKRPLVILVAGAGRGPLVDRTFKIIS
MLFMDSKVSIIAIEKNPQAYLYLQKRNFDCWDNRVKLIKEDMTKWQINEP
SEKRIQIDLCISELLGSFGCNELSPECLWSIEKYHSHNDTIFIPRSYSSY
IAPISSPLFYQKLSQTNRSLEAPWIVHRVPYCILSSRVNEVWRFEHPMAQ
KDTVQDEDDFTVEFSQSSLNEFKIKHRGEIHGPIGFFSANLYNNIFLSTL
PNDSTVRLKFSEETLMNTRREENLIKKCDHTPNMTSWSPIIFPLKQPISF
IDDSELSVLMSRIHSDTEQKVWYEWSLESFIYLMLSNYTSAVTAASMTIP
RSIVTDDTKTLAHNRHYSATTNQKLDNQIDLDQDIENEEEQGFLSNLETG
WQSVQDIHGLSETAKPDHLDSINKPMFDLKSTKALEPSNELPRHEDLEED
VPEVHVRVKTSVSTLHNVCGRAFSLPL

YBL085W, 3443 bp, CDS: 501-3443 (SEQ ID NO 31)
AAAGGGAAGTATGGCATGCCTAGAAATCTTTTCTGGAAAACTTGAAGCAT
ATCATATAATTGTATGAACTTGTCCTTCAAAAGATGTTACCAAATATTCA
AGAGTATGTGAGCTTTCTATTCTATTGACGCGTAAGAAAGGCTATCACGT
GTGGGGGGGAGAGCTCAGCCACATTGCACTACTTTCGAAACCGCGTAGTC
GGAAACGACATTCCCCCGTACCAAAACAAACGAAAGGACGTGAAAGGTAA
ATGAATAACATGGCACTAAAAATTTGGCAGAAAACGAAAAAAAAAAGGAA
AAAGAAACTGAAAACTATACGCTTCCCTTAGGATACTTTCTGATTTACAT
CCGAAGAATTGGGTGCGTCAATTAAAGGCAATTCTTCGCTCTATCAAGCA
GTTTTACTGCGTCTGTCTAAAGAAACAATTGTTTTACTGAATTTCAACAA
AGTTCTAACTCGAGGTGACCGGAGGCCACTGTAATAATAAAAAATAGAAG
ATGAGTCTCGAAGGAAATACCCTAGGCAAGGGGCCAAATCTTTTCCTCT
GTATATTGCGGTAAATCAGTACTCTAAACGAATGGAGGACGAGCTCAATA
TGAAACCAGGTGATAAAATTAAAGTCATTACTGATGATGGGGAGTACAAT
GACGGCTGGTATTATGGGCGCAATTTGAGAACCAAAGAGGAAGGTTTATA
CCCAGCGGTATTTACCAAAAGAATAGCAATAGAAAAACCAGAGAACCTGC
ACAAATCACCAACCCAAGAGAGTGGAAATTCTGGTGTTAAATATGGAAAT
TTAAATGATTCTGCGAGTAACATAGGTAAAGTCTCCTCGCATCAACAGGA
GAACAGATATACATCATTGAAAAGTACAATGAGCGATATAGACAAAGCCT
TGGAAGAGCTAAGAAGTGGTTCAGTTGAACAAGAGGTATCAAAATCGCCC
ACACGCGTGCCCGAAGTTAGCACTCCACAGTTGCAAGATGAACAGACTTT
GATTCAAGAAAAAACCAGAAATGAGGAAAACACGACACATGACTCGTTAT
TTTCTAGCACAGCGGATTTAAACTTAAGTTCTGAATCTTTGAAGAATATA
AGTAAGTCAAATATATCAACAAAATCCCTAGAACCGAGTTCGGAATCAGT
TCGTCAATTAGATTTGAAAATGGCTAAAAGTTGGAGCCCAGAAGAGGTTA
CTGATTACTTTAGCTTGGTTGGATTTGATCAATCCACTTGCAATAAATTC
AAAGAGCATCAAGTCTCCGGAAAAATACTACTGGAATTAGAACTGGAACA
CCTAAAAGAATTGGAAATAAATTCTTTTGGTATAAGATTTCAGATATTCA
AAGAAATAAGGAACATCAAGTCTGCAATTGATTCGTCGTCAAATAAACTG
GACGCCGACTACTCTACCTTTGCTTTTGAAAACCAAGCTGCCCAACTAAT
GCCTGCAGCCACTGTAAATAGAGACGAAATCCAACAACAAATTTCCTCCA
AGTGTAACAAGTTGTCAAGTGAAAGCTCTGATAGAAAATCATCTTCGGTC
ACCACAGAATTGCAAAGACCAAGCTCGGTTGTTGTTAATCCCAATTTTAA
ACTTCACGACCCAGCTGAGCAGATCCTAGATATGACAGAAGTTCCTAATT
TGTTTGCTGATAAAGATATTTTCGAATCACCGGGAAGGGCTCCAAAACCA
CCATCATATCCAAGTCCAGTTCAACCTCCACAATCGCCCTCTTTTAATAA
CAGGTACACAAATAATAACGCAAGGTTTCCTCCTCAAACAACATATCCAC
CTAAAAACAAGAACCCAACCGTTTATTCAAATGGGCTAATTCCAAATTCT
TCGACATCTTCCGATAATTCAACGGGCAAGTTCAAATTCCCTGCCATGAA
TGGTCATGACTCGAACTCTAGGAAAACAACACTGACATCTGCTACTATAC
CTTCTATTAACACGGTTAACACAGATGAATCTCTACCCGCAATTTCAAAT
ATATCTTCAAATGCTACATCTCATCATCCGAACAGAAATTCCGTTGTTTA
CAATAACCATAAGAGGACGGAATCCGGAAGCTCATTTGTTGATTTGTTCA
ACAGGATTTCAATGCTATCGCCAGTCAAGTCAAGTTTCGACGAAGAAGAA

ACGAAACAACCTTCAAAAGCTAGCAGAGCAGTTTTTGACTCAGCACGCAG
AAAGTCGTCTTACGGACATTCAAGAGATGCCTCACTTTCTGAAATGAAAA
AGCATAGGAGAAACTCTTCTATATTATCTTTTTTTTCTTCAAAAAGTCAG
TCTAATCCAACGTCACCAACCAAACAAACTTTCACTATCGATCCCGCAAA
GATGACTTCCCATTCTCGTTCTCAGTCGAATTCCTATTCGCATGCAAGAT
CACAATCTTACTCCCATAGTAGAAAACACTCGTTAGTTACCAGCCCCTTG
AAAACTTCTTTAAGCCCTATAAATTCCAAATCCAATATTGCTTTAGCGCA
TAGCGAAACTCCTACTAGTAGTAATAATAAGGAGGCAGTATCACAACCAA
GTGAAGGGAAGCACAAGCACAAGCACAAGCACAAGAGCAAGCACAAACAC
AAGAACAGTAGCTCCAAAGATGGCTCTTCCGAAGAAAAAAGCAAAAAGAA
ATTATTTAGTAGCACCAAAGAATCATTTGTAGGAAGCAAGGAATTCAAAA
GATCTCCCAGTGAACTTACCCAAAAATCTACCAAATCGATACTTCCCAGG
TCGAATGCTAAAAAGCAACAAACATCTGCTTTTACCGAAGGTATACGCTC
TATCACAGCAAAGGAATCTATGCAAACTGCGGACTGTTCAGGCTGGATGA
GCAAAAAGGTACCGGTGCTATGGGGACTTGGAAACAACGGTTTTTCACA
CTTCATGGAACAAGGCTTTCTTATTTTACGAATACCAATGATGAGAAGGA
GCGTGGCCTGATAGATATAACGGCACATAGGGTCTTACCTGCCAGTGATG
ATGATAGGCTCATTTCCTTATACGCTGCGAGCTTAGGAAAAGGAAAATAC
TGTTTCAAATTGGTCCCTCCGCAACCGGGGTCCAAAAAGGGGCTAACCTT
TACAGAACCTCGCGTTCACTATTTTGCAGTTGAGAATAAATCTGAAATGA
AGGCATGGCTGTCAGCCATAATAAAGGCCACTATTGATATTGATACAAGC
GTCCCTGTCATTAGTTCATATGCCACACCAACGATACCTCTAAGCAAGGC
ACAGACGCTATTGGAAGAAGCTAGGTTACAAACCCAGTTAAGAGATGCTG
AAGAGGAAGAGGGAAGAGATCAATTTGGATGGGATGACACCCAAAATAAA
AGAAATTCTAATTATCCAATCGAACAAGATCAATTTGAGACCAGCGATTA
CCTGGAAAGTTCAGCATTTGAATACCCTGGTGGCAGACTTTGA

YBL085W, 980 aa (SEQ ID NO 32)
MSLEGNTLGKGAKSFPLYIAVNQYSKRMEDELNMKPGDKIKVITDDGEYN
DGWYYGRNLRTKEEGLYPAVFTKRIAIEKPENLHKSPTQESGNSGVKYGN
LNDSASNIGKVSSHQQENRYTSLKSTMSDIDKALEELRSGSVEQEVSKSP
TRVPEVSTPQLQDEQTLIQEKTRNEENTTHDSLFSSTADLNLSSESLKNI
SKSNISTKSLEPSSESVRQLDLKMAKSWSPEEVTDYFSLVGFDQSTCNKF
KEHQVSGKILLELELEHLKELEINSFGIRFQIFKEIRNIKSAIDSSSNKL
DADYSTFAFENQAAQLMPAATVNRDEIQQQISSKCNKLSSESSDRKSSSV
TTELQRPSSVVVNPNFKLHDPAEQILDMTEVPNLFADKDIFESPGRAPKP
PSYPSPVQPPQSPSFNNRYTNNNARFPPQTTYPPKNKNPTVYSNGLIPNS
STSSDNSTGKFKFPAMNGHDSNSRKTTLTSATIPSINTVNTDESLPAISN
ISSNATSHHPNRNSVVYNNHKRTESGSSFVDLFNRISMLSPVKSSFDEEE
TKQPSKASRAVFDSARRKSSYGHSRDASLSEMKKHRRNSSILSFFSSKSQ
SNPTSPTKQTFTIDPAKMTSHSRSQSNSYSHARSQSYSHSRKHSLVTSPL
KTSLSPINSKSNIALAHSETPTSSNNKEAVSQPSEGKHKHKHKHSKHKH
KNSSSKDGSSEEKSKKKLFSSTKESFVGSKEFKRSPSELTQKSTKSILPR
SNAKKQQTSAFTEGIRSITAKESMQTADCSGWMSKKGTGAMGTWKQRFFT
LHGTRLSYFTNTNDEKERGLIDITAHRVLPASDDDRLISLYAASLGKGKY
CFKLVPPQPGSKKGLTFTEPRVHYFAVENKSEMKAWLSAIIKATIDIDTS
VPVISSYATPTIPLSKAQTLLEEARLQTQLRDAEEEEGRDQFGWDDTQNK
RNSNYPIEQDQFETSDYLESSAFEYPGGRL

YDR545W, 5891 bp, CDS: 501-5891 (SEQ ID NO 137)
TTCTATTATATTGGTCTTTTCGAGAGCGGAAGAAGTTGTAGGCTAAGCGC
AGGCTAAGCGTAGGTCCATATTTAAAGTATCCAAGAGAATATCCACGAAG
CGGCTGAGCAACGAACAGAATCCTGGTTCTCCTCGACTAAGCAGATAGTT
AAGATACTGTGCACCATGGAAATTGAAAACGAAAGTACGTACCGACTACT
TTATTTTTGCAGGCCGGAAATCAAGCGATGAATGAGACATCCTTCTGTTT
TCTATGTTGGGACAGACAGTCGCTTATCTTAGTGAGATTTCTTATTAACT

```
GAATTTTCTTTGCTGCTGCTGGAGATTTGCACCTGCATAGCGCAGATTCT
GCTTCTTCTAATAGAGTAGCTTAATTATTACATTCTTAGATGATGATAA
GACGGAAACTGGACAATCTTTTGTTTATATTGATGGATTTCTTGTCAAAA
AGCATAACAATCAACATACTATTGTTAATTTCGAAACTTACAAAAATAAA
ATGAAAGTTTCCGATAGGCGTAAGTTTGAAAAAGCAAACTTTGACGAGTT
TGAGTCGGCTCTAAATAACAAAAACGACTTGGTACATTGTCCCTCAATAA
CTTTATTTGAATCGATCCCCACGGAAGTGCGGTCATTCTACGAAGACGAA
AAGTCTGGCCTAATCAAAGTGGTAAAATTCAGAACTGGTGCAATGGATAG
GAAAAGGTCTTTTGAAAAAATTGTCATTTCCGTCATGGTCGGGAAAAATG
TACAAAAGTTCCTGACATTTGTTGAAGACGAACCAGATTTCCAGGGCGGA
CCAATCCCTTCAAAGTATCTTATTCCCAAGAAAATCAACTTGATGGTCTA
CACGTTGTTTCAAGTGCATACTTTGAAATTCAATAGAAAGGATTACGATA
CCCTTTCTCTTTTTTACCTCAACAGAGGATACTATAATGAGTTGAGTTTC
CGTGTCCTGGAACGTTGTCACGAAATAGCGAGTGCCAGGCCGAACGACAG
CTCTACGATGCGTACTTTCACTGACTTTGTTTCTGGCGCACCTATTGTAA
GGAGTCTTCAGAAAAGCACCATAAGGAAATATGGGTACAATTTGGCACCC
TACATGTTCTTGTTACTACACGTAGATGAGCTATCGATTTTTTCTGCATA
CCAAGCAAGTTTACCTGGCGAAAAGAAAGTCGACACAGAGCGGCTGAAGC
GTGATCTATGCCCACGTAAACCCATTGAGATAAAGTACTTTTCACAGATA
TGTAACGATATGATGAACAAAAAAGACCGATTGGGTGATATTTTGCATAT
TATCTTGCGAGCATGTGCGCTCAATTTCGGGGCGGGTCCCCGTGGTGGCG
CTGGTGACGAAGAGGATCGATCTATTACGAATGAAGAACCCATTATTCCC
TCTGTGGACGAGCATGGCTTGAAAGTATGTAAGTTGCGTAGTCCTAACAC
TCCACGAAGACTCAGAAAAACACTAGATGCCGTGAAAGCTTTATTGGTGT
CGTCTTGTGCTTGTACTGCAAGGGATTTAGATATATTTGATGACACCAAC
GGCGTTGCAATGTGGAAATGGATCAAAATTCTGTACCACGAAGTAGCGCA
GGAAACCACGCTGAAGGACTCTTATAGAATAACTTTGGTACCTTCTTCTG
ATGGTATATCAGTATGTGGAAAACTTTTTAATCGCGAGTATGTCCGCGGC
TTTTACTTTGCATGCAAGGCTCAGTTCGATAACCTTTGGGGAGAGTTGAA
CAACTGCTTTTATATGCCTACAGTGGTTGATATTGCCAGCCTCATTTTGC
GTAATCGAGAAGTTTTGTTCAGAGAGCCAAAGCGAGGAATTGACGAGTAT
CTGGAAAACGATTCTTTTCTTCAAATGATACCTGTTAAATATCGTGAAAT
TGTGCTGCCCAAGTTGAGAAGAGATACTAACAAAATGACCGCGGCTCTTA
AAAATAAAGTCACTGTTGCAATTGACGAGCTTACGGTGCCACTTATGTGG
ATGGTCCATTTTGCCGTAGGATACCCTTACCGTTATCCAGAGCTTCAGCT
ACTCGCTTTTGCCGGTCCTCAGCGCAACGTATACGTCGATGATACAACAA
GACGCATCCAACTGTACACTGATTACAACAAGAACGGTTCATCGGAGCCT
CGACTTAAGACGCTTGACGGACTCACTTCAGATTACGTGTTTTATTTTGT
CACTGTGCTAAGGCAAATGCAAATATGTGCGCTTGGTAACAGTTATGACG
CTTTTAATCATGATCCTTGGATGGATGTGGTGGGATTTGAGGATCCAGAT
CAAGTAACAAATCGAGACATTTCGAGGATAGTTTTGTATTCCTACATGTT
TCTGAATACCGCGAAGGGCTGTCTGGTTGAATACGCAACTTTTCGGCAGT
ACATGAGGGAACTTCCGAAGAATGCACCTCAGAAGCTGAATTTTCGGGAG
ATGCGTCAGGGGTTGATTGCCCTAGGACGGCACTGCGTAGGTAGCAGATT
TGAAACAGATTTGTACGAGTCGGCGACGAGTGAACTCATGGCCAATCATT
CCGTTCAAACAGGGCGAAATATTTACGGTGTGGATTCCTTTTCGTTAACT
AGTGTCAGTGGGACGACCGCCACTTTATTGCAGGAACGAGCTTCCGAGCG
CTGGATTCAATGGTTAGGCCTTGAAAGCGACTACCATTGTTCATTCTCTA
GTACTCGGAATGCGGAAGACGTAGTGGCAGGTGAGGCGGCGAGTTCAGAT
CATGATCAAAAAATTTCAAGAGTAACGCGAAAAAGGCCCCGAGAGCCCAA
GAGTACAAACGATATCCTCGTCGCAGGCCAGAAACTCTTTGGCAGCTCCT
TTGAATTCAGGGACTTGCATCAGTTGCGCTTATGTCATGAAATATACATG
GCAGACACACCCTCTGTGGCAGTACAGGCCCCACCGGGCTATGGTAAGAC
GGAGTTATTTCATCTCCCCTTGATAGCACTGGCGTCTAAGGGCGACGTGA
AATATGTGTCGTTTCTGTTTGTACCGTACACAGTGTTGCTTGCTAATTGC
ATGATCAGGTTGAGCCGATGCGGTTGCTTAATGTGGCCCCTGTAAGAAA
```

```
CTTTATTGAAGAAGGTTGCGATGGCGTTACTGATTTATACGTGGGGATCT
ACGATGATCTTGCTAGCACTAATTTCACAGACAGGATAGCTGCGTGGGAG
AATATTGTTGAGTGCACCTTTAGGACCAACAACGTAAAATTGGGTTACCT
CATTGTAGATGAGTTTCACAACTTTGAAACGGAGGTCTACCGGCAGTCGC
AATTTGGGGGCATAACTAACCTTGATTTGACGCTTTTGAGAAAGCAATC
TTTTTGAGCGGCACAGCACCTGAGGCTGTAGCTGATGCTGCGTTGCAGCG
TATTGGCTTACGGGACTGGCCAAGAAGTCGATGGACATCAACGAGCTCA
AACGGTCGGAAGATCTCAGCAGAGGTCTATCCAGCTATCCAACACGGATG
TTTAATCTAATCAAGGAGAAATCCGAGGTGCCTTTAGGGCATGTTCATAA
AATTTGGAAGAAAGTGGAATCACAGCCCGAAGAAGCACTGAAGCTTCTTT
TAGCCCTCTTTGAAATTGAACCAGAGTCGAAGGCCATTGTAGTTGCAAGC
ACAACCAACGAAGTGGAAGAATTGGCCTGCTCTTGGAGAAAGTATTTTAG
GGTGGTATGGATACACGGGAAGCTGGGTGCTGCAGAAAAGGTGTCTCGCA
CAAAGGAGTTTGTCACTGACGGTAGCATGCGAGTTCTCATCGGAACGAAA
TTAGTGACTGAAGGAATTGACATTAAGCAATTGATGATGGTGATCATGCT
TGATAATAGACTTAATATTATTGAGCTCATTCAAGGCGTAGGGAGACTAA
GAGATGGGGGCCTCTGTTATCTATTATCTAGAAAAAACAGTTGGGCGGCA
AGGAATCGTAAGGGTGAATTACCACCGATTAAGGAAGGCTGTATAACCGA
ACAGGTACGCGAGTTCTATGGACTTGAATCAAAGAAAGGAAAAAAGGGCC
AGCATGTTGGATGCTGTGGCTCCAGGACAGACCTGTCTGCTGACACAGTG
GAACTGATAGAAAGAATGGACAGATTGGCTGAAAAACAGGCGACAGCTTC
CATGTCGATCATTGCGTTACCGTCTAGCTTCCAGGAGAGCAATAGCAGTG
ACAGGTGCAGAAAGTATTGCAGCAGTGATGAGGACAGCGACACGTGCATT
CATGGTAGTGCTAATGCCAGTACCAATGCGACTACCAACTCCAGCACTAA
TGCTACTACCACTGCCAGCACCAACGTCAGGACTAGTGCTACTACCACTG
CCAGCATCAACGTCAGGACTAGTGCGATTACCACTGAAAGTACCAACTCC
AGCACTAATGCTACTACCACTGCCAGCACCAACGTCAGGACTAGTGCTAC
TACCACTGCCAGCATCAACGTCAGGACTAGTGCGACTACCACTGAAAGTA
CCAACTCCAACACTAGTGCTACTACCACCGAAAGTACCGACTCCAACACT
AGTGCTACTACCACCGAAAGTACCGACTCCAACACTAGTGCTACTACCAC
TGCTAGCACCAACTCCAGCACTAATGCCACTACCACTGCTAGCACCAACT
CCAGCACTAATGCCACTACCACTGAAAGTACCAACGCTAGTGCCAAGGAG
GACGCCAATAAAGATGGCAATGCTGAGGATAATAGATTCCATCCAGTCAC
CGACATTAACAAAGAGTCGTATAAGCGGAAAGGGAGTCAAATGGTTTTGC
TAGAGAGAAAGAAACTGAAAGCACAATTTCCCAATACTTCCGAGAATATG
AATGTCTTACAGTTTCTTGGATTTCGGTCTGACGAAATTAAACATCTTTT
CCTCTATGGTATTGACGTATACTTCTGCCCAGAGGGAGTATTCACACAAT
ACGGATTATGCAAGGGCTGTCAAAAGATGTTCGAGCTCTGTGTCTGTTGG
GCTGGCCAGAAAGTATCGTATCGGAGGATGGCTTGGGAAGCACTAGCTGT
GGAGAGAATGCTGCGAAATGACGAGGAATACAAAGAATACTTGGAAGACA
TCGAGCCATATCATGGGGACCCTGTAGGATATTTGAAATATTTTAGCGTA
AAAAGGGGAGAGATCTACTCTCAGATACAGAGAAATTATGCTTGGTACCT
GGCCATTACTAGAAGAAGAGAAACAATTAGTGTATTGGATTCGACAAGAG
GCAAGCAAGGGAGCCAAGTTTTCCGCATGTCTGGAAGGCAGATCAAAGAG
TTGTATTATAAAGTATGGAGCAACTTGCGTGAATCGAAGACAGAGGTGCT
GCAGTACTTTTTGAACTGGGACGAGAAAAAGTGCCGGGAAGAATGGGAGG
CAAAAGACGATACGGTCTTTGTGGAAGCGCTCGAGAAAGTTGGAGTTTTT
CAGCGTTTGCGTTCCATGACGAGCGCTGGACTGCAGGGTCCGCAGTACGT
CAAGCTGCAGTTTAGCAGGCATCATCGACAGTTGAGGAGCAGATATGAAT
TAAGTCTAGGAATGCACTTGCGAGATCAGCTTGCGCTGGGAGTTACCCCA
TCTAAAGTGCCGCATTGGACGGCATTCCTGTCGATGCTGATAGGGCTGTT
CTACAATAAAACATTTCGGCAGAAACTGGAATATCTTTTGGAGCAGATTT
CGGAGGTGTGGTTGTTACCACATTGGCTTGATTTGGCAAACGTTGAAGTT
CTCGCTGCAGATAACACGAGGGTACCGCTGTACATGCTGATGGTAGCGGT
TCACAAAGAGCTGGATAGCGATGATGTTCCAGACGGTAGATTTGATATAA
TATTACTATGTAGAGATTCGAGCAGAGAAGTTGGAGAGTGA
```

YDR545W, 1796 aa (SEQ ID NO 138)
MKVSDRRKFEKANFDEFESALNNKNDLVHCPSITLFESIPTEVRSFYEDE
KSGLIKVVKFRTGAMDRKRSFEKIVISVMVGKNVQKFLTFVEDEPDFQGG
PIPSKYLIPKKINLMVYTLFQVHTLKFNRKDYDTLSLFYLNRGYYNELSF
RVLERCHEIASARPNDSSTMRTFTDFVSGAPIVRSLQKSTIRKYGYNLAP
YMFLLLHVDELSIFSAYQASLPGEKKVDTERLKRDLCPRKPIEIKYFSQI
CNDMMNKKDRLGDILHIILRACALNFGAGPRGGAGDEEDRSITNEEPIIP
SVDEHGLKVCKLRSPNTPRRLRKTLDAVKALLVSSCACTARDLDIFDDTN
GVAMWKWIKILYHEVAQETTLKDSYRITLVPSSDGISVCGKLFNREYVRG
FYFACKAQFDNLWGELNNCFYMPTVVDIASLILRNREVLFREPKRGIDEY
LENDSFLQMIPVKYREIVLPKLRRDTNKMTAALKNKVTVAIDELTVPLMW
MVHFAVGYPYRYPELQLLAFAGPQRNVYVDDTTRRIQLYTDYNKNGSSEP
RLKTLDGLTSDYVFYFVTVLRQMQICALGNSYDAFNHDPWMDVVGFEDPD
QVTNRDISRIVLYSYMFLNTAKGCLVEYATFRQYMRELPKNAPQKLNFRE
MRQGLIALGRHCVGSRFETDLYESATSELMANHSVQTGRNIYGVDSFSLT
SVSGTTATLLQERASERWIQWLGLESDYHCSFSSTRNAEDVVAGEAASSD
HDQKISRVTRKRPREPKSTNDILVAGQKLFGSSFEFRDLHQLRLCHEIYM
ADTPSVAVQAPPGYGKTELFHLPLIALASKGDVKYVSFLFVPYTVLLANC
MIRLSRCGCLNVAPVRNFIEEGCDGVTDLYVGIYDDLASTNFTDRIAAWE
NIVECTFRTNNVKLGYLIVDEFHNFETEVYRQSQFGGITNLDFDAFEKAI
FLSGTAPEAVADAALQRIGLTGLAKKSMDINELKRSEDLSRGLSSYPTRM
FNLIKEKSEVPLGHVHKIWKKVESQPEEALKLLLALFEIEPESKAIVVAS
TTNEVEELACSWRKYFRVVWIHGKLGAAEKVSRTKEFVTDGSMRVLIGTK
LVTEGIDIKQLMMVIMLDNRLNIIELIQGVGRLRDGGLCYLLSRKNSWAA
RNRKGELPPIKEGCITEQVREFYGLESKKGKKGQHVGCCGSRTDLSADTV
ELIERMDRLAEKQATASMSIIALPSSFQESNSSDRCRKYCSSDEDSDTCI
HGSANASTNATTNSSTNATTTASTNVRTSATTTASINVRTSAITTESTNS
STNATTTASTNVRTSATTTASINVRTSATTTESTNSNTSATTTESTDSNT
SATTTESTDSNTSATTTASTNSSTNATTTASTNSSTNATTTESTNASAKE
DANKDGNAEDNRFHPVTDINKESYKRKGSQMVLLERKKLKAQFPNTSENM
NVLQFLGFRSDEIKHLFLYGIDVYFCPEGVFTQYGLCKGCQKMFELCVCW
AGQKVSYRRMAWEALAVERMLRNDEEYKEYLEDIEPYHGDPVGYLKYFSV
KRGEIYSQIQRNYAWYLAITRRRETISVLDSTRGKQGSQVFRMSGRQIKE
LYYKVWSNLRESKTEVLQYFLNWDEKKCREEWEAKDDTVFVEALEKVGVF
QRLRSMTSAGLQGPQYVKLQFSRHHRQLRSRYELSLGMHLRDQLALGVTP
SKVPHWTAFLSMLIGLFYNKTFRQKLEYLLEQISEVWLLPHWLDLANVEV
LAADNTRVPLYMLMVAVHKELDSDDVPDGRFDIILLCRDSSREVGE

YCR005C, 1883 bp, CDS: 501-1883 (SEQ ID NO 71)
AGAGTTGTTGCCACAACATAAGCCGCTTTGGAGTGTTGAACAAATCCGTC
CTTGGGTCATTCAATCAATGGCTTGGCGGTATCTCAAAAGAGCGCAAACT
AATAGCGCGCACATTCGACGCATTTATCCGGTGGTCATCGACTAGGGGCG
AAGAGGTCACGACCTATTTTTCTTGCAGAAAAAAGTGTGACCTTTTCC
GTAGCTAGACGTCTATCAGGGCGTCAGCAATGGGAGGCACAGCGGAAAAA
CAATAACAATGGTAAGCGCAATTACCTTTTGAGCGTTACATTCGTATGAA
ATTGGTGACGTTAATCTAAAGATAGTCATGCTCTCAAAAGGGCCCATTAT
TCTCGACGTTGAGCGTATATAAGACTATTAAAACTTGGTTCTTTAGATAT
GGTGTTCGTTCCTCATTATTAAGTTTCAGGGAACAATATCAACACATATC
ATAACAGGTTCTCAAAACTTTTTGTTTTAATAATACTAGTAACAAGAAAA
ATGACAGTTCCTTATCTAAATTCAAACAGAAATGTTGCATCATATTTACA
ATCAAATTCAAGCCAAGAAAAGACTCTAAAAGAGAGATTTAGCGAAATCT
ACCCCATCCATGCTCAAGATGTAAGGCAATTCGTTAAAGAGCATGGCAAA
ACTAAAATTAGCGATGTTCTATTAGAACAGGTATATGGTGGTATGAGAGG
TATTCCAGGGAGCGTATGGGAAGGTTCCGTTTTGGACCCAGAAGACGGTA
TTCGTTTCAGAGGTCGTACGATCGCCGACATTCAAAAGGACCTGCCCAAG
GCAAAAGGAAGCTCACAACCACTACCAGAAGCTCTCTTTTGGTTATTGCT

AACTGGCGAGGTTCCAACTCAAGCGCAAGTTGAAAACTTATCAGCTGATC
TAATGTCAAGATCGGAACTACCTAGTCATGTCGTTCAACTTTTGGATAAT
TTACCAAAGGACTTACACCCAATGGCTCAATTCTCTATTGCTGTAACTGC
CTTGGAAAGCGAGTCAAAGTTTGCTAAGGCTTATGCTCAAGGAATTTCCA
AGCAAGATTATTGGAGTTATACTTTTGAAGATTCACTAGACTTGCTGGGT
AAATTGCCAGTTATTGCAGCTAAAATTTATCGTAATGTATTCAAAGATGG
CAAAATGGGTGAAGTGGACCCAAATGCCGATTATGCTAAAAATCTGGTCA
ACTTGATTGGTTCTAAGGATGAAGATTTCGTGGACTTGATGAGACTTTAT
TTAACCATTCATTCGGATCACGAAGGTGGTAATGTATCTGCACATACATC
CCATCTTGTGGGCTCAGCACTATCATCACCTTATCTGTCCCTTGCATCAG
GTTTGAACGGGTTGGCTGGCCCACTTCATGGGCGTGCTAATCAAGAAGTA
CTAGAATGGTTATTTGCACTTAAAGAAGAGGTAAATGATGACTACTCTAA
AGATACGATCGAAAAATATTTATGGGATACTCTAAACTCAGGAAGAGTCA
TTCCCGGTTATGGTCATGCTGTGCTAAGGAAAACTGATCCTCGTTATATG
GCTCAGCGTAAGTTTGCCATGGACCATTTTCCAGATTATGAATTATTCAA
GTTAGTTTCATCAATATACGAGGTAGCACCTGGCGTATTGACTGAACATG
GTAAAACTAAAAATCCATGGCCAAATGTAGATGCTCACTCTGGTGTCTTA
TTACAATATTATGGACTAAAAGAATCTTCTTTCTATACCGTTTTATTTGG
CGTTTCAAGGGCATTTGGTATTCTTGCTCAATTGATCACTGATAGGGCCA
TCGGTGCTTCCATTGAAAGGCCAAAGTCCTATTCTACTGAGAAATACAAG
GAATTGGTCAAAAACATTGAAAGCAAACTATAG

YCR005C, 460 aa (SEQ ID NO 72)
MTVPYLNSNRNVASYLQSNSSQEKTLKERFSEIYPIHAQDVRQFVKEHGK
TKISDVLLEQVYGGMRGIPGSVWEGSVLDPEDGIRFRGRTIADIQKDLPK
AKGSSQPLPEALFWLLLTGEVPTQAQVENLSADLMSRSELPSHVVQLLDN
LPKDLHPMAQFSIAVTALESESKFAKAYAQGISKQDYWSYTFEDSLDLLG
KLPVIAAKIYRNVFKDGKMGEVDPNADYAKNLVNLIGSKDEDFVDLMRLY
LTIHSDHEGGNVSAHTSHLVGSALSSPYLSLASGLNGLAGPLHGRANQEV
LEWLFALKEEVNDDYSKDTIEKYLWDTLNSGRVIPGYGHAVLRKTDPRYM
AQRKFAMDHFPDYELFKLVSSIYEVAPGVLTEHGKTKNPWPNVDAHSGVL
LQYYGLKESSFYTVLFGVSRAFGILAQLITDRAIGASIERPKSYSTEKYK
ELVKNIESKL

YOL126C, 1772 bp, CDS: 501-1772 (SEQ ID NO 345)
ATCCCCTCATACTTTTCCGTTTGTATCTCCTACTTTCTTACTTCCTTTTT
TTCTTCTTTATTTGCTTGGTTTACCATTGAAGTCCATTTTTACTACAGAC
AATAGCTAGTCATTCGCTATCTTCCGTTTGTCACTTTTTTTCAAATTTCT
CATCTATATAGCGAAGTACGGAAAAGATGTCACTTGCCGGCATCTCGGCC
TTCCCCGGCCAAATGGACTCATCATCTACGATACGGCCCCTTTAATCCGC
AATTACTTTGCCCATTCGGCCGTAGCCGTTCTAAAGCCGCCGTGCCTTGC
CCCCAATACTCCCCTAATGATCCGGGAAGTTCCGGTTTTTTTCCTTTGTT
TAGTGGCATTTTGTGTTGCCCAAGGTTGGGAAGGTCCGATTTGACTTTAA
GGAACTACGGAAGGTATCTAAGGTTTCTAAAAACAATATACACGCGCGTG
CGTAGATATATAAAGATAAAGATTTATCGATATGAGATAAAGATTGCTGC
ATGATTCTCCTTCTGATTCTTTTTCCCTGTATATATTTCTCCCCTTCTG
TATAAATCGTACAGTCAGAAGTAGTCCAGAATATAGTGCTGCAGACTATT
ACAAAAGTTCAATACAATATCATAAAAGTTATAGTAACATGCCTCACTCA
GTTACACCATCCATAGAACAAGATTCGTTAAAAATTGCCATTTTAGGTGC
TGCCGGTGGTATCGGGCAGTCGTTATCGCTGCTTTTGAAAGCTCAGTTGC
AATACCAGTTAAAGGAGAGCAACCGGAGCGTTACCCACATTCATCTGGCT
CTTTACGATGTCAACCAAGAAGCCATCAACGGTGTTACCGCCGACTTGTC
TCATATAGACACCCCCATTTCCGTGTCGAGCCACTCTCCTGCAGGTGGCA
TTGAGAACTGTTTGCATAACGCTTCTATTGTTGTCATTCCTGCAGGTGTT
CCAAGAAAACCTGGCATGACTCGTGATGACTTATTTAACGTGAATGCTGG
TATCATTAGCCAGCTCGGTGATTCTATTGCAGAATGTTGTGATCTTTCCA

AGGTCTTCGTTCTTGTCATTTCCAACCCTGTTAATTCTTTAGTCCCAGTG
ATGGTTTCTAACATTCTTAAGAACCATCCTCAGTCTAGAAATTCCGGCAT
TGAAAGAAGGATCATGGGTGTCACCAAGCTCGACATTGTCAGAGCGTCCA
CTTTTCTACGTGAGATAAACATTGAGTCAGGGCTAACTCCTCGTGTTAAC
TCCATGCCTGACGTCCCTGTAATTGGCGGGCATTCTGGCGAGACTATTAT
TCCGTTGTTTTCACAGTCAAACTTCCTATCGAGATTAAATGAGGATCAAT
TGAAATATTTAATACATAGAGTCCAATACGGTGGTGATGAAGTGGTCAAG
GCCAAGAACGGTAAAGGTAGTGCTACCTTATCGATGGCCCATGCCGGTTA
TAAGTGTGTTGTCCAATTTGTTTCTTTGTTATTGGGTAACATTGAGCAGA
TCCATGGAACCTACTATGTGCCATTAAAAGATGCGAACAACTTCCCCATT
GCTCCTGGGGCAGATCAATTATTGCCTCTGGTGGACGGTGCAGACTACTT
TGCCATACCATTAACTATTACTACAAAGGGTGTTTCCTATGTGGATTATG
ACATCGTTAATAGGATGAACGACATGGAACGCAACCAAATGTTGCCAATT
TGCGTCTCCCAGTTAAAGAAAAATATCGATAAGGGCTTGGAATTCGTTGC
ATCGAGATCTGCATCATCTTAA

YOL126C, 423 aa (SEQ ID NO 346)
MILLLILFPCIYFLPFCINRTVRSSPEYSAADYYKSSIQYHKSYSNMPHS
VTPSIEQDSLKIAILGAAGGIGQSLSLLLKAQLQYQLKESNRSVTHIHLA
LYDVNQEAINGVTADLSHIDTPISVSSHSPAGGIENCLHNASIVVIPAGV
PRKPGMTRDDLFNVNAGIISQLGDSIAECCDLSKVFVLVISNPVNSLVPV
MVSNILKNHPQSRNSGIERRIMGVTKLDIVRASTFLREINIESGLTPRVN
SMPDVPVIGGHSGETIIPLFSQSNFLSRLNEDQLKYLIHRVQYGGDEVVK
AKNGKGSATLSMAHAGYKCVVQFVSLLLGNIEQIHGTYYVPLKDANNFPI
APGADQLLPLVDGADYFAIPLTITTKGVSYVDYDIVNRMNDMERNQMLPI
CVSQLKKNIDKGLEFVASRSASS

YBR019C, 2600 bp, CDS: 501-2600 (SEQ ID NO 39)
ATCGCTTCGCTGATTAATTACCCCAGAAATAAGGCTAAAAAACTAATCGC
ATTATCATCCTATGGTTGTTAATTTGATTCGTTAATTTGAAGGTTTGTGG
GGCCAGGTTACTGCCAATTTTTCCTCTTCATAACCATAAAAGCTAGTATT
GTAGAATCTTTATTGTTCGGAGCAGTGCGGCGCGAGGCACATCTGCGTTT
CAGGAACGCGACCGGTGAAGACGAGGACGCACGGAGGAGAGTCTTCCGTC
GGAGGGCTGTCGCCCGCTCGGCGGCTTCTAATCCGTACTTCAATATAGCA
ATGAGCAGTTAAGCGTATTACTGAAAGTTCCAAAGAGAAGGTTTTTTTAG
GCTAAGATAATGGGGCTCTTTACATTTCCACAACATATAAGTAAGATTAG
ATATGGATATGTATATGGTGGTAATGCCATGTAATATGATTATTAAACTT
CTTTGCGTCCATCCAAAAAAAAAGTAAGAATTTTTGAAAATTCAATATAA
ATGACAGCTCAGTTACAAAGTGAAAGTACTTCTAAAATTGTTTTGGTTAC
AGGTGGTGCTGGATACATTGGTTCACACACTGTGGTAGAGCTAATTGAGA
ATGGATATGACTGTGTTGTTGCTGATAACCTGTCGAATTCAACTTATGAT
TCTGTAGCCAGGTTAGAGGTCTTGACCAAGCATCACATTCCCTTCTATGA
GGTTGATTTGTGTGACCGAAAAGGTCTGGAAAAGGTTTTCAAAGAATATA
AAATTGATTCGGTAATTCACTTTGCTGGTTTAAAGGCTGTAGGTGAATCT
ACACAAATCCCGCTGAGATACTATCACAATAACATTTTGGGAACTGTCGT
TTTATTAGAGTTAATGCAACAATACAACGTTTCCAAATTTGTTTTTTCAT
CTTCTGCTACTGTCTATGGTGATGCTACGAGATTCCCAAATATGATTCCT
ATCCCAGAAGAATGTCCCTTAGGGCCTACTAATCCGTATGGTCATACGAA
ATACGCCATTGAGAATATCTTGAATGATCTTTACAATAGCGACAAAAAAA
GTTGGAAGTTTGCTATCTTGCGTTATTTTAACCCAATTGGCGCACATCCC
TCTGGATTAATCGGAGAAGATCCGCTAGGTATACCAAACAATTTGTTGCC
ATATATGGCTCAAGTAGCTGTTGGTAGGCGCGAGAAGCTTTACATCTTCG
GAGACGATTATGATTCCAGAGATGGTACCCCGATCAGGGATTATATCCAC
GTAGTTGATCTAGCAAAAGGTCATATTGCAGCCCTGCAATACCTAGAGGC
CTACAATGAAAATGAAGGTTTGTGTCGTGAGTGGAACTTGGGTTCCGGTA
AAGGTTCTACAGTTTTTGAAGTTTATCATGCATTCTGCAAAGCTTCTGGT

ATTGATCTTCCATACAAAGTTACGGGCAGAAGAGCAGGTGATGTTTTGAA
CTTGACGGCTAAACCAGATAGGGCCAAACGCGAACTGAAATGGCAGACCG
AGTTGCAGGTTGAAGACTCCTGCAAGGATTTATGGAAATGGACTACTGAG
AATCCTTTTGGTTACCAGTTAAGGGGTGTCGAGGCCAGATTTTCCGCTGA
AGATATGCGTTATGACGCAAGATTTGTGACTATTGGTGCCGGCACCAGAT
TTCAAGCCACGTTTGCCAATTTGGGCGCCAGCATTGTTGACCTGAAAGTG
AACGGACAATCAGTTGTTCTTGGCTATGAAAATGAGGAAGGGTATTTGAA
TCCTGATAGTGCTTATATAGGCGCCACGATCGGCAGGTATGCTAATCGTA
TTTCGAAGGGTAAGTTTAGTTTATGCAACAAAGACTATCAGTTAACCGTT
AATAACGGCGTTAATGCGAATCATAGTAGTATCGGTTCTTTCCACAGAAA
AAGATTTTTGGGACCCATCATTCAAAATCCTTCAAAGGATGTTTTTACCG
CCGAGTACATGCTGATAGATAATGAGAAGGACACCGAATTTCCAGGTGAT
CTATTGGTAACCATACAGTATACTGTGAACGTTGCCCAAAAAAGTTTGGA
AATGGTATATAAAGGTAAATTGACTGCTGGTGAAGCGACGCCAATAAATT
TAACAAATCATAGTTATTTCAATCTGAACAAGCCATATGGAGACACTATT
GAGGGTACGGAGATTATGGTGCGTTCAAAAAAATCTGTTGATGTCGACAA
AAACATGATTCCTACGGGTAATATCGTCGATAGAGAAATTGCTACCTTTA
ACTCTACAAAGCCAACGGTCTTAGGCCCCAAAAATCCCCAGTTTGATTGT
TGTTTTGTGGTGGATGAAAATGCTAAGCCAAGTCAAATCAATACTCTAAA
CAATGAATTGACGCTTATTGTCAAGGCTTTTCATCCCGATTCCAATATTA
CATTAGAAGTTTTAAGTACAGAGCCAACTTATCAATTTTATACCGGTGAT
TTCTTGTCTGCTGGTTACGAAGCAAGACAAGGTTTTGCAATTGAGCCTGG
TAGATACATTGATGCTATCAATCAAGAGAACTGGAAAGATTGTGTAACCT
TGAAAAACGGTGAAACTTACGGGTCCAAGATTGTCTACAGATTTTCCTGA

YBR019C, 699 aa (SEQ ID NO 40)
MTAQLQSESTSKIVLVTGGAGYIGSHTVVELIENGYDCVVADNLSNSTYD
SVARLEVLTKHHIPFYEVDLCDRKGLEKVFKEYKIDSVIHFAGLKAVGES
TQIPLRYYHNNILGTVVLLELMQQYNVSKFVFSSSATVYGDATRFPNMIP
IPEECPLGPTNPYGHTKYAIENILNDLYNSDKKSWKFAILRYFNPIGAHP
SGLIGEDPLGIPNNLLPYMAQVAVGRREKLYIFGDDYDSRDGTPIRDYIH
VVDLAKGHIAALQYLEAYNENEGLCREWNLGSGKGSTVFEVYHAFCKASG
IDLPYKVTGRRAGDVLNLTAKPDRAKRELKWQTELQVEDSCKDLWKWTTE
NPFGYQLRGVEARFSAEDMRYDARFVTIGAGTRFQATFANLGASIVDLKV
NGQSVVLGYENEEGYLNPDSAYIGATIGRYANRISKGKFSLCNKDYQLTV
NNGVNANHSSIGSFHRKRFLGPIIQNPSKDVFTAEYMLIDNEKDTEFPGD
LLVTIQYTVNVAQKSLEMVYKGKLTAGEATPINLTNHSYFNLNKPYGDTI
EGTEIMVRSKKSVDVDKNMIPTGNIVDREIATFNSTKPTVLGPKNPQFDC
CFVVDENAKPSQINTLNNELTLIVKAFHPDSNITLEVLSTEPTYQFYTGD
FLSAGYEARQGFAIEPGRYIDAINQENWKDCVTLKNGETYGSKIVYRFS

YDR345C, 2204 bp, CDS: 501-2204 (SEQ ID NO 123)
TCTTAGCTATATTCTTCCAGCTTCGCCTGCTGCCCGGTCATCGTTCCTGT
CACGTAGTTTTTCCGGATTCGTCCGGCTCATATAATACCGCAATAAACAC
GGAATATCTCGTTCCGCGGATTCGGTTAAACTCTCGGTCGCGGATTATCA
CAGAGAAAGCTTCGTGGAGAATTTTTCCAGATTTTCCGCTTTCCCCGATG
TTGGTATTTCCGGAGGTCATTATACTGACCGCCATTATAATGACTGTACA
ACGACCTTCTGGAGAAAGAAACAACTCAATAACGATGTGGGACATTGGGG
GCCCACTCAAAAAATCTGGGGACTATATCCCCAGAGAATTTCTCCAGAAG
AGAAGAAAAGTCAAAGTTTTTTTTCGCTTGGGGGTTGCATATAAATACAG
GCGCTGTTTTATCTTCAGCATGAATATTCCATAATTTTACTTAATAGCTT
TTCATAAATAATAGAATCACAAACAAAATTTACATCTGAGTTAAACAATC
ATGAATTCAACTCCAGATTTAATATCTCCACAAAAGTCAAGTGAGAATTC
GAATGCTGACCTGCCTTCGAATAGCTCTCAGGTAATGAACATGCCTGAAG
AAAAAGGTGTTCAAGATGATTTCCAAGCTGAGGCCGACCAAGTACTTACC
AACCCAAATACAGGTAAAGGTGCATATGTCACTGTGTCTATCTGTTGTGT

TATGGTTGCCTTCGGTGGTTTCGTTTTCGGTTGGGATACTGGTACCATTT
CTGGTTTCGTCGCCCAAACTGATTTCTTGAGAAGATTCGGTATGAAGCAT
AAAGATGGTAGTTATTATTTGTCTAAGGTTAGAACTGGTTTAATTGTCTC
CATTTTCAACATTGGTTGTGCCATTGGTGGTATTATTTTGGCTAAATTGG
GTGATATGTACGGTCGTAAAATGGGTTTGATTGTCGTTGTTGTTATCTAC
ATCATCGGTATTATTATTCAAATTGCATCCATCAACAAATGGTACCAATA
TTTCATCGGTAGAATTATTTCCGGTTTGGGTGTTGGTGGTATTGCCGTTT
TATCTCCTATGTTGATTTCTGAAGTCGCTCCTAAGGAAATGAGAGGTACT
TTAGTCTCCTGTTACCAACTGATGATTACCTTGGGTATTTTCTTGGGTTA
CTGTACCAACTTCGGTACTAAGAACTACTCCAACTCTGTGCAATGGAGAG
TTCCATTAGGTTTGTGTTTTGCCTGGGCTTTGTTTATGATCGGTGGTATG
ACTTTCGTTCCAGAATCCCCACGTTATTTGGTTGAAGCTGGTCAAATTGA
CGAAGCAAGAGCATCTCTTTCCAAAGTTAACAAGGTTGCCCCAGACCATC
CATTCATTCAACAAGAGTTGGAAGTTATTGAAGCTAGTGTTGAAGAAGCT
AGAGCTGCTGGTTCAGCATCATGGGGTGAGTTGTTCACTGGTAAGCCGGC
CATGTTTAAGCGTACTATGATGGGTATCATGATCCAATCTCTACAACAAT
TGACTGGTGATAACTATTTCTTCTACTATGGTACTACCGTTTTTAACGCT
GTTGGTATGAGTGATTCTTTCGAAACTTCTATTGTTTTCGGTGTCGTCAA
CTTCTTCTCTACTTGTTGTTCTTTGTACACTGTCGATCGTTTTGGACGTC
GTAACTGTTTGTTATATGGTGCCATTGGTATGGTCTGCTGTTATGTAGTT
TACGCTTCTGTTGGTGTCACCAGACTATGGCCAAATGGTGAAGGTAATGG
TTCATCCAAGGGTGCTGGTAACTGTATGATTGTCTTTGCCTGTTTCTATA
TTTTCTGTTTTGCTACCACTTGGGCTCCAATTGCTTATGTTGTTATTTCT
GAAACTTTCCCATTGAGAGTCAAGTCTAAGGCTATGTCTATTGCTACAGC
TGCTAATTGGTTGTGGGGTTTCTTGATTGGTTTCTTCACTCCATTTATTA
CTGGTGCTATTAACTTCTACTACGGTTACGTTTTCATGGGCTGTATGGTT
TTCGCCTACTTCTACGTTTTCTTCTTTGTGCCAGAAACTAAGGGTTTGAC
TTTGGAAGAAGTCAATGATATGTACGCTGAAGGTGTTCTACCATGGAAGT
CTGCTTCATGGGTTCCAACATCTCAAAGAGGTGCTAACTACGATGCTGAT
GCATTGATGCATGATGACCAGCCATTCTACAAGAAAATGTTCGGCAAGAA
ATAA

YDR345C, 567 aa (SEQ ID NO 124)
MNSTPDLISPQKSSENSNADLPSNSSQVMNMPEEKGVQDDFQAEADQVLT
NPNTGKGAYVTVSICCVMVAFGGFVFGWDTGTISGFVAQTDFLRRFGMKH
KDGSYYLSKVRTGLIVSIFNIGCAIGGIILAKLGDMYGRKMGLIVVVVIY
IIGIIIQIASINKWYQYFIGRIISGLGVGGIAVLSPMLISEVAPKEMRGT
LVSCYQLMITLGIFLGYCTNFGTKNYSNSVQWRVPLGLCFAWALFMIGGM
TFVPESPRYLVEAGQIDEARASLSKVNKVAPDHPFIQQELEVIEASVEEA
RAAGSASWGELFTGKPAMFKRTMMGIMIQSLQQLTGDNYFFYYGTTVFNA
VGMSDSFETSIVFGVVNFFSTCCSLYTVDRFGRRNCLLYGAIGMVCCYVV
YASVGVTRLWPNGEGNGSSKGAGNCMIVFACFYIFCFATTWAPIAYVVIS
ETFPLRVKSKAMSIATAANWLWGFLIGFFTPFITGAINFYYGYVFMGCMV
FAYFYVFFFVPETKGLTLEEVNDMYAEGVLPWKSASWVPTSQRGANYDAD
ALMHDDQPFYKKMFGKK

YKR097W, 2150 bp, CDS: 501-2150 (SEQ ID NO 263)
ATAGGAAAAAACCGAGCTTCCTTTCATCCGGCGCGGCTGTGTTCTACATA
TCACTGAAGCTCCGGGTATTTTAAGTTATACAAGGGAAAGATGCCGGCTA
GACTAGCAAGTTTTAGGCTGCTTAACATTATGGATAGGCGGATAAAGGGC
CCAAACAGGATTGTAAAGCTTAGACGCTTCTGGTTGGACAATGGTACGTT
TGTGTATTAAGTAAGGCTTGGCTGGGGATAGCAACATTGGGCAGAGTATA
GAAGACCACAAAAAAAAGGTATATAAGGGCAGAGAAGTCTTTGTAATGTG
TGTAACTTCTCTTCCATGTGTAATCAGTATTTCTACTTACTTCTTAAATA
TACAGAAGTAAGACAGATAACCAACAGCCTTTCCCAGATATACATATATA
TCTTTATTTCAGCTTAAACAATAATTATATTTGTTTAACTCAAAAATAAA

AAAAAAAAACCAAACTCACGCAACTAATTATTCCATAATAAAATAACAAC
ATGTCCCCTTCTAAAATGAATGCTACAGTAGGATCTACTTCCGAAGTTGA
ACAAAAAATCAGACAAGAATTGGCTCTTAGTGACGAAGTCACCACCATCA
GACGCAATGCTCCAGCTGCCGTTTTGTATGAAGATGGTCTAAAAGAAAAT
AAAACTGTCATTTCATCAAGCGGTGCATTGATCGCTTATTCCGGTGTTAA
AACCGGAAGATCTCCAAAGGACAAACGTATTGTTGAAGAACCTACCTCGA
AAGACGAAATTTGGTGGGGTCCGGTCAATAAACCATGTTCTGAAAGAACA
TGGTCTATCAACCGTGAAAGAGCTGCAGATTACTTGAGAACAAGAGACCA
CATTTATATTGTCGATGCATTTGCAGGATGGGATCCAAAATACAGAATCA
AAGTCCGCGTTGTTTGTGCCAGGGCTTACCACGCTTTATTCATGACAAAT
ATGCTTATTAGACCTACAGAAGAAGAATTAGCCCATTTTGGAGAACCTGA
TTTTACTGTCTGGAACGCTGGTCAGTTCCCAGCCAATTTACACACCCAGG
ATATGTCTTCAAAGAGTACTATAGAAATTAACTTCAAAGCAATGGAAATG
ATCATTTTAGGTACCGAATACGCCGGTGAAATGAAAAAAGGTATTTTCAC
AGTTATGTTTTACTTGATGCCTGTGCACCATAACGTTTTAACTTTGCACT
CTTCCGCCAACCAGGGTATTCAAAACGGTGACGTTACTTTATTCTTTGGC
CTAAGTGGTACCGGGAAAACCACTTTATCCGCAGACCCACATAGATTGTT
GATCGGCGATGATGAACATTGTTGGTCCGACCATGGTGTCTTCAATATCG
AAGGTGGTTGTTACGCCAAGTGTATTAATTTATCTGCCGAAAAGGAGCCT
GAAATTTTCGACGCTATCAAGTTTGGTTCTGTATTAGAAAACGTTATCTA
TGACGAGAAGTCGCATGTAGTCGACTATGACGACTCTTCTATTACTGAAA
ATACTAGATGTGCCTACCCAATTGACTACATTCCAAGTGCCAAGATTCCA
TGTTTGGCGGACTCTCATCCAAAGAACATTATCCTGCTAACTTGTGATGC
TTCGGGTGTTTTACCACCAGTATCTAAATTGACTCCTGAACAAGTCATGT
ACCATTTCATCTCTGGTTACACTTCTAAAATGGCTGGTACTGAGCAAGGT
GTCACTGAACCTGAACCAACATTTTCATCTTGTTTCGGACAACCCTTCCT
AGCCTTGCACCCTATTAGATACGCAACCATGTTAGCTACAAAGATGTCTC
AACATAAAGCTAATGCGTACTTAATCAACACCGGCTGGACTGGTTCTTCC
TACGTATCTGGTGGTAAACGTTGCCCATTGAAGTACACAAGGGCCATTCT
GGATTCTATTCATGATGGTTCGTTAGCCAATGAAACGTACGAAACTTTAC
CGATTTTCAATCTTCAAGTACCTACCAAGGTTAACGGTGTTCCAGCTGAG
CTTTTGAATCCTGCTAAAAACTGGTCTCAAGGTGAATCCAAATACAGAGG
TGCAGTTACCAACTTGGCCAACTTGTTTGTTCAAAAATTTCAAGATTTATC
AAGACAGAGCCACACCAGATGTATTAGCCGCTGGTCCTCAATTCGAGTAA

YKR097W, 549 aa (SEQ ID NO 264)
MSPSKMNATVGSTSEVEQKIRQELALSDEVTTIRRNAPAAVLYEDGLKEN
KTVISSSGALIAYSGVKTGRSPKDKRIVEEPTSKDEIWWGPVNKPCSERT
WSINRERAADYLRTRDHIYIVDAFAGWDPKYRIKVRVVCARAYHALFMTN
MLIRPTEEELAHFGEPDFTVWNAGQFPANLHTQDMSSKSTIEINFKAMEM
IILGTEYAGEMKKGIFTVMFYLMPVHHNVLTLHSSANQGIQNGDVTLFFG
LSGTGKTTLSADPHRLLIGDDEHCWSDHGVFNIEGGCYAKCINLSAEKEP
EIFDAIKFGSVLENVIYDEKSHVVDYDDSSITENTRCAYPIDYIPSAKIP
CLADSHPKNIILLTCDASGVLPPVSKLTPEQVMYHFISGYTSKMAGTEQG
VTEPEPTFSSCFGQPFLALHPIRYATMLATKMSQHKANAYLINTGWTGSS
YVSGGKRCPLKYTRAILDSIHDGSLANETYETLPIFNLQVPTKVNGVPAE
LLNPAKNWSQGESKYRGAVTNLANLFVQNFKIYQDRATPDVLAAGPQFE

YMR173W, 1793 bp, CDS: 501-1793 (SEQ ID NO 313)
AAACAAGTGTAACATAAATACATTCTGTAAATCTACAAAAATCGTTAGTG
CTGTTTTCTTTTTGAGATTGAAAAGTACGAATCATACACATCTCTTATTC
TGAGAAGGGTGCATATGACGTAAATCAATGCGTACAAAGCGGTTTCCGGT
GCTGGCCTGGCCCACCACAGTTTTGGCGTGGTTGATTTTAAAAACCTTCG
GGAAGGTGAAAAAACCACTCCGAAGGTTCGAGGATGACAAATCGCCCCTT
AGCTGTGGCCATACAAGCTTGGCACCGACGAAAAGGGAAAAGGAAAAG
AATGTCGTACAAGAACTCTTACAACCACGTTGAGATTTCATTTAACAACG

CCCCCCTTTCCATTATATAAGAAGGCATTAATTTTTATGTAATAAAAAAA
GAATTTCTCGAAAATGTCTTACAATTAATTTTTTCTTTTGTAGAGTAGGG
CTTTAATAGACTGATATATACGGTATTATAAGTGAACGAAAAAAACAGCA
ATGGGTTTATTTGATAAAGTGAAGCAATTTGCTAACAGCAATAATAACAA
CAATGATTCTGGCAATAACAATCAAGGCGATTATGTTACCAAAGCTGAGA
ATATGATCGGCGAAGATAGAGTCAATCAATTCAAAAGCAAAATCGGAGAG
GACAGATTTGATAAGATGGAGTCCAAGGTTCGTCAACAATTTTCTAATAC
CTCTATAAATGACAACGACTCCAACAACAACGACTCATATGGTTCTAATA
ACAACGATTCATATGGTTCTAACAACAATGATTCATATGGCTCTAACAAC
AATGATTCATATGGCTCCAACAACAATGATTCATATGGCTCTAACAACGA
TGATTCCTACGGTTCTTCCAACAAGAAGAAGAGCTCTTATGGTTCTAACA
ATGACGATTCGTACGGCTCCAGCAACAACAATGACTCTTACGGTTCCAAC
AACAATGACTCTTACGGTTCCAACAACAATGACTCTTACGGTTCCAACAA
TGACGACTCTTACGGTTCGTCAAACAAGAATAAGAGCTCTTACGGTTCCA
ACAATGACGATTCTTATGGCTCTAACAATGATGATTCATATGGTTCTTCC
AACAAGAAGAAGAGTTCTTATGGTTCCAGCAACAACGATTCGTATGGTTC
TAACAACGATGATTCATATGGTTCTAACAACAATGATTCATATGGCTCTA
ACAACGATGATTCCTACGGTTCTTCCAACAAGAAGAAGAGCTCTTATGGT
TCTAACAATGACGATTCGTACGGCTCCAGCAACAACAATGACTCTTACGG
TTCCAACAATGACGACTCTTACGGTTCGTCAAACAAGAATAAGAGCTCTT
ACGGTTCTTCTAGCAACGATGATTCTTACGGATCTTCCAATAACGACGAC
TCTTACGGTTCTTCCAACAAGAAGAAGAGTTCTTATGGTTCCAACAATGA
CGATTCTTATGGCTCTAACAATGATGATTCATATGGTTCTTCCAACAAGA
AGAAGAGTTCTTATGGTTCCAGCAACAACGATTCGTATGGTTCTAACAAC
GATGATTCCTACGGTTCTTCTAACAAAAGAAGAGTTCTTATGGTTCCAA
CAACGATGATTCATACGGCTCCAGCAACAACAATGACTCTTACGGTTCCA
ACAATGACGACTCTTACGGTTCCTCTAATAGAAACAAGAACTCCTATGGG
TCTTCCAACTACGGTTCATCCAACAATGATGACTCTTATGGTTCATCTAA
TAGAGGCGGTCGTAATCAATACGGTGGTGACGACGATTACTAA

YMR173W, 430 aa (SEQ ID NO 314)
MGLFDKVKQFANSNNNNNDSGNNNQGDYVTKAENMIGEDRVNQFKSKIGE
DRFDKMESKVRQQFSNTSINDNDSNNNDSYGSNNNDSYGSNNNDSYGSNN
NDSYGSNNNDSYGSNNDDSYGSSNKKKSSYGSNNDDSYGSSNNNDSYGSN
NNDSYGSNNNDSYGSNNDDSYGSSNKNKSSYGSNNDDSYGSNNDDSYGSS
NKKKSSYGSSNNDSYGSNNDDSYGSNNNDSYGSNNDDSYGSSNKKKSSYG
SNNDDSYGSSNNNDSYGSNNDDSYGSSNKNKSSYGSSSNDDSYGSSNNDD
SYGSSNKKKSSYGSNNDDSYGSNNDDSYGSSNKKKSSYGSSNNDSYGSNN
DDSYGSSNKKKSSYGSNNDDSYGSSNNNDSYGSNNDDSYGSSNRNKNSYG
SSNYGSSNNDDSYGSSNRGGRNQYGGDDDY

YIL057C, 995 bp, CDS: 501-995 (SEQ ID NO 217)
CCCAACAGATTTCAAGTCTGTCGCCTTAACCACTCGGCCATAGTGCCTAA
AACAATGTAGGTTATTTAAGCAAGTATTGTAGATACTTTTCGTAATAAAC
TACAATGCACCCACGACTCGCGGTGTAATGATGGCATGAAATCATTGAAC
GAAGTTTTGCGGCTATACGGCTGAAGGACGAGACTAAAGGGACAGGAATT
ATTAATGCGGGGTATAATTTGAATAGTATTAACGGGCACTGCCGTTTAGC
CATCAAATGCTATTGTGGGGTATTCTCTCTACTTTTTGTTCTTGGCTTG
AACCTTTTCGGCGGTTGGCAATCGTCCGTATATAAGCATCGGCTGTCCCA
ATCCTCTATTGCCCTTTTCCCTTGCACCTCCTTCTCAATTCTTCGTATCT
TTCGCGTAAAGGTAGATCTTGATTCACCTATCTGTCGAAACACGATTAAG
TGCAAACGAAACAACGTACAGTATATAACAAAGTATTTTAAATAATAAGA
ATGACGAAAAGGATAAGAAAGCAAAGGGTCCTAAGATGTCCACCATCAC
TACAAAAAGTGGTGAGTCCTTAAAGGTTTTTGAGGATTTGCATGATTTTG
AAACATATTTAAAGGGTGAGACGGAAGATCAAGAGTTCGACCATGTCCAT
TGCCAACTGAAGTACTATCCACCCTTTGTCCTGCATGATGCGCATGATGA

TCCGGAAAAGATCAAAGAGACTGCCAATTCGCACTCTAAGAAGTTTGTTC
GCCATTTACACCAGCATGTTGAGAAGCACCTGCTAAAGGACATCAAAACC
GCTATCAACAAGCCAGAATTGAAATTCCACGATAAGAAAAAGCAGGAATC
CTTTGACCGGATTGTTTGGAATTATGGCGAAGAAACGGAGTTGAACGCCA
AGAAATTCAAGGTGTCTGTCGAAGTTGTATGTAAACACGATGGCGCAATG
GTAGATGTTGATTACAAGACAGAACCCTTGCAGCCACTCATCTAA

YIL057C, 164 aa (SEQ ID NO 218)
MTKKDKKAKGPKMSTITTKSGESLKVFEDLHDFETYLKGETEDQEFDHVH
CQLKYYPPFVLHDAHDDPEKIKETANSHSKKFVRHLHQHVEKHLLKDIKT
AINKPELKFHDKKKQESFDRIVWNYGEETELNAKKFKVSVEVVCKHDGAM
VDVDYKTEPLQPLI

YDR544C, 929 bp, CDS: 501-929 (SEQ ID NO 135)
TAAAGTAGTCGGTACGTACTTTCGTTTTCAATTTCCATGGTGCACAGTAT
CTTAACTATCTGCTTAGTCGAGGAGAACCAGGATTCTGTTCGTTGCTCAG
CCGCTTCGTGGATATTCTCTTGGATACTTTAAATATGGACCTACGCTTAG
CCTGCGCTTAGCCTACAACTTCTTCCGCTCTCGAAAAGACCAATATAATA
GAAAGTTATAAATTACATTTCCTTATTAGGTATACGACCTCGCGCTTCGA
AGTAGAGGAGCCCTTTTTGGCGTACCTACATATGGCGCGTCAGACAGACA
AACTTCCCCCAAAAATGTATTACCCCGCCGAATAAGAAAACAGACCCATT
CACCCACGACGTATCAAGTTACTTCCTTGGTGCAATGTCCCACTATAAAA
AAATTCCTTGACGCTAGATCGTTGGACTAAAATCTGCGTCACAATCGCCT
AAACAGGAAATATTGCCTATTTTCGTACAAGGTTACTTCCTAGATGCTAT
ATGTCCCTACGGCCTTGTCTAACACCATCCAGCATGCAATACAGTGACAT
ATATATACACACCACACCACACCCACACACACCACACCACACCCACCACA
CCCACACCACACCCACACCCACACCACACCCACACACCCACACACCCACA
CCAGAGAGAAGCCTAAGCCTAAGACTAAGACAAGCCAAGCCTGACCAACC
TGTCTCTCAAATTACCCTCCATTACCCTACCTCCCCACTCGTTACCCTGA
CTCATTCAACTATACCACCCCAACCACCATCCATCTCCCTGTGTACTACC
ACCAACCGACCGTCCACCATAACCGTTACCCTCCAATTACCCATATCCAA
CTCCACTACCACTTACCCTACCATCTCCCATCTACTACTCACCATACTAT
TGTTCTACCCACCACTATTGAAACGCTAA

YDR544C, 142 aa (SEQ ID NO 136)
MSLRPCLTPSSMQYSDIYIHTTPHPHTPHHTHHTHTTPTPTPHPHTHTPT
PERSLSLRLRQAKPDQPVSQITLHYPTSPLVTLTHSTIPPQPPSISLCTT
TNRPSTITVTLQLPISNSTTTYPTISHLLLTILLFYPPLLKR

YKR040C, 1004 bp, CDS: 501-1004 (SEQ ID NO 255)
GGGCTTTTCCAGTGCCGCGGCCTCGAGATCCAGGCACCAGGAACTAGGCA
CGCTGTGTATTCTAACACATTGAAGGGCCTAGGCCCGCTGACGTGGGGTC
TAGTTCCACTTTTTCATTACCTTTTCTCGGTCTTTTCTTGCTCCCACAGG
CCGTTAATGGCCTGAAACAGTTTTGTGACTTTGGACTTATGATAACGATG
TTTGTCCGGGTGCCACCGGATTCTATCGCGGCGAATCAAGTCTAGTCTGT
TTGCATCCATCAAGGCACTGCTCATTGTGTAAAATTGTTCTACGCTTTTG
TCATCAATCATATCTAAACTCACAGCCGCTAGGGTAGGTGTGCCTGGCAG
TGGTAAGGTAGCCGGCTCGTCTTTGGTCATGCGCCAATACTGTCGAACGG
CCCGCGCGTAGCGTTCTTCGGCTTCAACCTTAGAGCTGATACCTTTTGCC
TGGTCAAAGGCGAAAACGTCTACCTCGCTTTCACTGCTGCTTTCGCTTTC
ATGACTTCGTTTCAAGCGGTCTCTTTCGCTCTCGGTTGTAACACACTTGT
AGCCTGCTATGCTTTCACCGTACTCGAAAAGCGTAGCCTCATGACTAGTT
GTACCAACGCCCTTTCTTTTCTTTTTTTTCTCTTGACACTTCGGCGTATT
CATCGCCACTGGTACAAGCCGTATGGTGCTTTTTTGCTCATTTTCGTTTT
GACGTTGCGATGGTTTCGCGGACCAATCGCATGGGTGGTGGTGGATGTTG
TCTTTGCTAGTTGCAACGTAGTCTTCTTCTCTCCTGCGCTTTCTGACGAA

AATTGGCCTTACGTATCTTTTTTCGGCGTCGTTGTCGTCATCGCTGTTCA
TATAATCGTCGTCACTCATATCGGCGCTTTTACTGCATGCTGTCTTTTGA
AGAGAGTTTCATTGAAAAGTAGTGAAGAAAAAAAAAAAAAAAAAAAAAAA
AAAAAGGAAAAAAGCTTACATACGGAAAGAGAAAAAAAAAAAAGAAATT
TTAA

YKR040C, 167 aa (SEQ ID NO 256)
MTSFQAVSFALGCNTLVACYAFTVLEKRSLMTSCTNALSFLFFLLTLRRI
HRHWYKPYGAFLLIFVLTLRWFRGPIAWVVVDVVFASCNVVFFSPALSDE
NWPYVSFFGVVVVIAVHIIVVTHIGAFTACCLLKRVSLKSSEEKKKKKKK
KKEKSLHTEREKKKKKF

YNL338W, 659 bp, CDS: 501-659 (SEQ ID NO 337)
TAAAGTAGTCGGTACGTACGTTCGTTTTCAATTTCCATGGTGCACAGTAT
CTTAACTATCTGCTTAGTCGAGGAGAACCAGGATTCTGTTCGTTGCTCAG
CCGCTTCGTGGATATTCTCTTGGATACTTTAAATATGGACCTACGCTTAG
CCTGCGCTTAGCCTACAACTTCTTCCGCTCTCGAAAAGACCAATATAATA
GAAAGTTATAAATTACATTTCCTTATTAGGTATACGACCTCGCGCTTCGA
AGTAGAGGAGCCCTTTTGGCGTACCTACATATGGCGCGTCAGACAGACA
AACTTCCCCCAAAAATGTATTACCCCGCCGAATAAGAAAACAGACCCATT
CACCCACGACGTATCAAGTTACTTCCTTGGTGCAATGTCCCACTATAAAA
AAATTCCTTGACGCTAGATCGTTGGACTAAAATCTGCGTCACAATCGCCT
AAACAGGAAATATTGCCTATTTTCGTACAAGGTTACTTCCTAGATGCTAT
ATGTCCCTACGGCCTTGTCTAACACCATCCAGCATGCAATACAGTGACAT
ATATATACCCACACCCACACCCACACACCACACCCACACACCCACACCAC
ACCCACACCCACACACCCACACCCACACCCATCACAACCCTAACCCTACC
CTATTCTAA

YNL338W, 52 aa (SEQ ID NO 338)
MSLRPCLTPSSMQYSDIYIPTPTPTHHTHTPTPHPHPHTHTHTHHNPNPT
LF

YJR115W, 1010 bp, CDS: 501-1010 (SEQ ID NO 235)
GCCAGTATCCCTTTCTGAAATAAGCTAAACCCTTGCAACCACCAGGGGTG
CCGCCGTCCTAACTTTCCAGCCTGGCAGCGCGTCGAGTCGCCGAATGTTG
CGGGCGCTGCCCCGCCCGCAACACCGCGCCCGCCCTGCCTCAGCTTAACC
GAAACCACACGGGTCTGCCATCTTCCATATACCCTGGCTCTTCTTTCACA
ATGCCCGCTCACAACGCCAACTGCAAAAGAAGCCCGCCCTTAGTCGGTTT
TCCCCACTTTGATATAACCCCCCCCCCCCCCCCCGCATCAACTGGTAA
TTTAACCCAAACACCACGGGGTCATAATTTAAAAGCGAAAAACCTTAAAG
CGTTCTCGAAGAAATCTTCCTGTAGATGATGTCGTAGCAAACTTATCTTT
TAGAGTGTTTGTGCTTACTGCATTGTCAGATCAAAATTTACGTAGCCGCC
CTTTTCAACCCCTGTCGAAGAGTAGCATAACAGCAGCGTAGTGAACGTGC
ATGTTCACAAATACACGTACAATATTAATATACAATAGTAAGGTGATGAA
CACACACACACACACACACACACACACACACACACACATATATATATATA
CAGGAGATCAAGTTAGTGTGAGGGGACGACTACTGAGTTTGAAGTTCTTT
AAAGTGTTAAAGTTATTTTTTCCCCTCTCCCACCTCGTTGGCAACCTCTCA
CCCACCGCTTAGCAGCATGTCTCCGTACATGACCATACCTCAGCAATACT
TATACATAAGCAAGATACGTTCCAAGCTGTCTCAGTGCGCCCTTACTCGA
CACCACCACAGAGAACTTGATCTACGAAAATGGTGGGCCACGCCAATAT
GCTGGACAGGATCCTCGACGAAATAGACGAAATCGACAGCGAGGTAGTAC
TGTGTGACGCTGCCGATGGTTCTTCTACTGCAGAAGCTCATTCCGCTTCC
CCAGCATCCAGCGACTCTTCTCCTCTCACTAATAACATCCGGCCCATTAG
CATTATGTGA

YJR115W, 169 aa (SEQ ID NO 236)
MFTNTRTILIYNSKVMNTHTHTHTHTHTHTHIYIYTGDQVSVRGRLLSLKFF
KVLKLFFPSPTSLATSHPPLSSMSPYMTIPQQYLYISKIRSKLSQCALTR
HHHRELDLRKMVGHANMLDRILDEIDEIDSEVVLCDAADGSSTAEAHSAS
PASSDSSPLTNNIRPISIM

YBL072C, 1103 bp, CDS: 501-1103 (SEQ ID NO 27)
GTCCTACACACGAGCATCGCTGGGAAAGCTTGAGGGCTTTCTCTTACGCAGTGTTCATGGTGTTACGGG
ATGGAACTGTTTCATATACGTTATTTACAGGCCTATCTTAAAGTTATAGGAAATTACACTTGCCATTTG
CTTTTTGGTACTCACAAGAAGACGTTATAAACACACCAGGACAAAAAGTATGTGCTATGGTCATATGAG
TAATGGAACTACATATTATTTTGAATGCTACAGGACCTCTCTTTGAATGGAATAGATAGTGGAAAAAGT
AAACTTAACTAAAAGGGATGATATAAATTGTGACAGGAGCAGTGCACTAAACTGAATCCTTTGTGTACC
CCAAAAATCAAGCCTCTTATGAAACGCCGAGTTTTTCACAAGAAGAGATGAAAAGAAACCAAAGCATAT
TTCAAGATAAGAAAAAAATTCCGCAACTTTTGTACGTTCTTTATTTTACTAACAAGCGTCATTAAATTT
TCTATTACAGTTACAAAATGGGTATTTCTCGTGATTCTCGTCACAAAAGATCCGCTACCGGTGCCAAGC
GTGCTCAATTCAGAAAGAAGAGAAAGTTCGAATTAGGCCGTCAACCAGCCAACACCAAGATCGGTGCTA
AGAGAATTCACTCTGTTAGAACTAGAGGTGGTAACAAGAAATACAGAGCTCTAAGAATTGAAACCGGTA
ACTTTTCTTGGGCTTCTGAAGGTATCTCCAAGAAGACCAGAATTGCTGGTGTTGTTTACCATCCATCCA
ACAATGAATTGGTTAGAACTAACACTTTGACCAAGGCTGCCATTGTCCAAATTGATGCTACTCCATTCA
GACAATGGTTCGAAGCTCACTACGGTCAAACCTTGGGTAAGAAGAAGAACGTCAAGGAAGAAGAAACTG
TTGCCAAGAGCAAGAACGCTGAAAGAAAGTGGGCTGCTAGAGCTGCTTCTGCCAAGATCGAATCTTCCG
TTGAATCTCAATTCAGCGCCGGTAGATTATACGCTTGTATCTCTTCCAGACCAGGTCAATCCGGTAGAT
GTGATGGTTACATCTTGGAAGGTGAAGAATTAGCTTTCTACCTAAGAAGATTGACTGCTAAGAAATAG

YBL072C, 200 aa (SEQ ID NO 28)
MGISRDSRHKRSATGAKRAQFRKKRKFELGRQPANTKIGAKRIHSVRTRGGNKKYRALRIETGNFSWAS
EGISKKTRIAGVVYHPSNNELVRTNTLTKAAIVQIDATPFRQWFEAHYGQTLGKKKNVKEEETVAKSKN
AERKWAARAASAKIESSVESQFSAGRLYACISSRPGQSGRCDGYILEGEELAFYLRRLTAKK

YBL092W, 893 bp, CDS: 501-893 (SEQ ID NO 33)
TACTGGAGAAGAGTGTTTGATTCCAGCAGAAGGTAATACGCACCTTTCTCATCTATTTGCAGAATCGTT
TTATTAAAATACTTTTAAAGAATTTAGATTTTGATAATTAGTTCATTCTCTTTTACAAAGATAATCACC
AAACAGGGACAATACACTGAACGATAAAAGTATGTGACATATAGAATGCTAGAATGAATAGCCTAGACT
GCATTGTTATGAGAGCAACGTTTGATATTTGTGGCGATTGGAACAAACATAGTACATGCCAAAATGAGA
TGAAATGTCCAATTTGAACTGATTAACATACACGCGCAAGCTCGTATTTGTTTACTGGTACACCTAGAG
TTAGCCGATCAAAGAGACAGTGGCAGATATATGGGAAAATTTTCTCCGGAAGATTGCATGCGAGAGTCT
CATAACCAGTCATTTCCCAAGATACAATTCTCGGAGCTGTTATACTAACAAACTTTTAATTTTCATTTT
TTTTTTTTTTGATTAGATGGCCTCCTTACCTCACCCAAAGATTGTCAAGAAGCACACCAAGAAGTTCA
AGCGTCATCACTCTGACCGTTACCACAGAGTTGCTGAAAACTGGAGAAAGCAAAAGGGTATTGACTCTG
TTGTTAGAAGAAGATTCAGAGGTAACATCTCTCAACCAAAGATCGGTTACGGTTCTAACAAGAAGACCA
AGTTTTTGTCACCATCTGGTCACAAGACTTTCTTAGTCGCTAACGTTAAGGATTTGGAAACCTTGACCA
TGCACACCAAGACTTACGCCGCTGAAATTGCTCACAACATCTCCGCTAAGAACAGAGTTGTCATTTTGG
CTAGAGCTAAGGCTTTGGGTATCAAGGTCACCAACCCAAAGGGTCGTTTGGCTTTGGAAGCTTAA

YBL092W, 130 aa (SEQ ID NO 34)
MASLPHPKIVKKHTKKFKRHHSDRYHRVAENWRKQKGIDSVVRRRFRGNISQPKIGYGSNKKTKFLSPS
GHKTFLVANVKDLETLTMHTKTYAAEIAHNISAKNRVVILARAKALGIKVTNPKGRLALEA

YBR009C, 812 bp, CDS: 501-812 (SEQ ID NO 37)
GAAAAATCGCCCGGGCATTTCGTTATCTTCCACGCTAAAAGTCAAGGAGAGATATTACGGCCAGGATCG
CAAAGGTGCAGAGCAAGGAAATGTGAGAAATTGTGAGAACGATAATGTATGGGACAATGCGAAAATGTG
AGAACGAGAGCAAAAATCTTTTTTGTATCTCCCCGCCGAATTTGGAAACCGCGTTCTGAAAACTTCGCA
TCTTCACATAGTAAAACTGTTCCGAGCGCTTCTCCCCATAATGGTTAGTGGTAAAAACCGAAGTTGTTT

ACTTTAGCAAATGCCCGCGAATACGGTGGTAAATTGCCACCCCCCTTCCCCATTCATTGGGTAAAGAC
CAATTTGATGGATAAATTGGTTGTGGAAAAGGTCTAATTCTTTTTCCTATAAATACCGAGATATTTTTT
CTATATGATGGTTTCCGTCGCATTATTGTACTCTATAGTACTAAAGCAACAAACAAAAACAAGCAACAA
ATATAATATAGTAAAATATGTCCGGTAGAGGTAAAGGTGGTAAAGGTCTAGGTAAAGGTGGTGCCAAGC
GTCACAGAAAGATTCTAAGAGATAACATCCAAGGTATTACTAAGCCAGCTATCAGAAGATTAGCTAGAA
GAGGTGGTGTCAAGCGTATTTCTGGTTTGATCTACGAAGAAGTCAGAGCTGTCTTGAAATCCTTCTTGG
AATCCGTCATCAGAGACTCTGTTACCTACACCGAACACGCCAAGAGAAAGACTGTTACTTCTTTGGATG
TTGTTTATGCTTTGAAGAGACAAGGTAGAACCTTATACGGTTTCGGTGGTTAA

YBR009C, 103 aa (SEQ ID NO 38)
MSGRGKGGKGLGKGGAKRHRKILRDNIQGITKPAIRRLARRGGVKRISGLIYEEVRAVLKSFLESVIRD
SVTYTEHAKRKTVTSLDVVYALKRQGRTLYGFGG

YBR189W, 1501 bp, exon1: 501-507, intron1: 508-920, exon2: 921-1501
(SEQ ID NO 59)
TGGCTTCTTCTTTGCCTGTTTTGCCCAGCTGGTTGATACGGGCACGTAACTGATTTAATTCTTGGTCCC
TTTCTAGTGATAAATCTCGCAGAGAGGGCATACTGGTTGTAAAAAGTAGTCGCAACAAGTAAGTCGTAA
AAAAGTAGATGTAATGGAAGGCTTTGAAGGAACGGCTAGCCAGCTTTTCTGTATCATTCCTAGCCTAAT
TGACAGCATCTTGACCTTCTAGTATGGAAACTTTCAATTTCAGAAAGCGGTGTTCCCCGCTGCGACGAT
TTAATCCGTACATTTACACATCTGTACATTTTTCATATTCGCAAAACAAAGGTTACTTGAAAAAATCAT
AAAGTTGGCGGCTTCAGGTGGACGCGCTTCACTCATGTAGCTTAACATTCAATCCCATTAAGCATTATG
CATAAATTTCATGAAGTTTACTTAATAAAATTGTTCATTTGCATAGACAAGAAAGAAAGCAACAAGACA
ACTAAGACTAAGCAACAATGCCAAGTACGTATTAGACTATATCGAAGAGGAGGGAAATTCTTCACTCTG
ACTCGTTGATTTTGAAAGAGGTTCGGGTCCTCATAAATATTTGAGAATATGAAATTCCATAATAGTATA
CCTTCATTGAGTAGCACGACAACAGCCTGAATTACTATCCATATTATGAATATCTTTATTTACACTGAA
CTCCCGACACTTCAGTTAAACAGGGATACATTAGAGATCAAGGTGATCTAATAGGGAACATCTCTCTCG
TAACAATGGGACAGTATTTTATTTTCCAAGGCGGATACCTAATTATGCGTTTTTAATCATATCTCTACA
ATATTTATGAGCACTTACTTGGGCCCTTGCAGACTTTTGTTCCGGGAAAACTTTTGACTAACAAGAATC
CAATTTTACTTTTTTTTTTTTAGGAGCTCCAAGAACTTACTCTAAGACTTACTCTACACCAAAGAGACC
TTACGAATCTTCTCGTTTGGACGCAGAATTGAAGTTGGCCGGTGAATTCGGTTTGAAGAACAAGAGAGA
AATTTACAGAATTTCTTTCCAATTGTCTAAAATTCGTCGTGCTGCCAGAGACTTGTTAACTAGAGACGA
AAAGGACCCAAAGAGATTGTTCGAAGGTAATGCCTTGATCAGAAGATTGGTTAGAGTTGGTGTCTTGTC
CGAAGACAAGAAGAAGTTGGATTATGTTTTGGCTTTGAAGGTTGAAGATTTCTTGGAAAGAAGATTGCA
AACTCAAGTCTACAAGTTGGGTTTGGCCAAGTCTGTCCACCACGCCAGAGTTTTAATCACTCAAAGACA
CATTGCTGTTGGTAAGCAAATCGTCAACATCCCATCTTTCATGGTCAGATTGGACTCTGAAAAGCACAT
TGACTTCGCTCCAACTTCTCCATTCGGTGGTGCTAGACCAGGTAGAGTTGCTAGAAGAAACGCTGCTAG
AAAGGCTGAAGCTTCCGGTGAAGCTGCTGAAGAAGCCGAAGACGAAGAATAA YBR189W, 195 aa (SEQ ID NO 60)
MPRAPRTYSKTYSTPKRPYESSRLDAELKLAGEFGLKNKREIYRISFQLSKIRRAARDLLTRDEKDPKR
LFEGNALIRRLVRVGVLSEDKKKLDYVLALKVEDFLERRLQTQVYKLGLAKSVHHARVLITQRHIAVGK
QIVNIPSFMVRLDSEKHIDFAPTSPFGGARPGRVARRNAARKAEASGEAAEEAEDEE YBR191W, 1371 bp, exon1: 501-511, intron1: 512-899, exon2: 900-1371
(SEQ ID NO 61)
AATCCTTATTGTCAGAAATTGAAGCCGTTAATATTTAAAGGCTAATTCTCCATGCCATCTTGCATTCAC
TTTGGTATATATCTCTTGACCTCAATATATCTCGATAATATAAATCGCAATATTATACTTGTTAGTCTG
ACAGTTTTACACCTGTACATCTTCACCATCACCACACCCTTTTTTACTGGAGGCAAGGATGAGTTTGAA
TATCGCCTTTTTCCCAGCCGCTAGAACATGCTCAGAACCGAGGAAAAGCACCGCTGCCAAACCTCCTTT
GATGTGTTGGCCCACCGCTACTAGTGGCCGTGCTGGAAGCCCAGGCAGCGGTGGGGGCCACAATACGAG
AGCTGGAAAGGTAAACGGTCTCTGCGCCTCTGTGAAATTTTATCACCAATGGAGTGTCATGTCTGGTAA
AGATAATATAGAAAGTAGTGTGCAATTTCAGGCATTACCGATTGAACTTTGGAATAAGAGAACCAAGAC
AAAAATAACTAGCAACAATGGGTAAATCGTATGTCATTTAATCCTATGAATCTACAGCACGAACGAATC
ATGGTATCTCAAACCGAACATATCGTCACAGAAATAAAAAGATTTAAAGACGTGTCTAGTGTGAATAAA
GCAAACATATCATTAGAGCAAAATATTGGGCAGATAAGATGATGCTACACTGATTCTGAGAAAATTACG
TGACATGATAGGCTTTTAACGGGCTGTAAGTCATTAGTTTACAGTCGTTGCTTTGAAAATTAGTTCAAC ATTAGAAGTGTAGTAATTACAAGCCCTTTTTCCAAACATTCGGTTATGTGCTGGGACGCATCTCAGAAA
CTCGCAAAACAATAGAATACTAACATGATTTCTTATAAATCTTAATTTTGATTTATTTCCTTATAATAC
AGACACGGTTACAGATCTCGTACTCGTTACATGTTCCAACGTGACTTCAGAAAGCATGGTGCCGTCCAT
CTTTCTACTTACTTGAAGGTCTACAAGGTTGGTGACATTGTCGACATCAAAGCCAATGGTTCTATCCAA
AAGGGTATGCCACACAAGTTTTACCAAGGTAAGACCGGTGTTGTCTACAACGTTACTAAGTCTTCTGTT
GGTGTTATCATCAACAAGATGGTCGGTAACAGATATCTAGAAAAAAGATTAAACTTAAGAGTTGAACAC
ATCAAGCACTCCAAGTGTAGACAAGAATTTTTGGAAAGAGTTAAGGCCAATGCTGCTAAGCGTGCTGAA
GCTAAGGCTCAAGGTGTTGCTGTTCAATTGAAGAGACAACCAGCTCAACCAAGAGAATCCCGTATCGTT
TCTACTGAAGGTAACGTTCCTCAAACTTTGGCCCCAGTTCCATACGAAACTTTCATCTAA YBR191W, 160 aa (SEQ ID NO 62)
MGKSHGYRSRTRYMFQRDFRKHGAVHLSTYLKVYKVGDIVDIKANGSIQKGMPHKFYQGKTGVVYNVTK
SSVGVIINKMVGNRYLEKRLNLRVEHIKHSKCRQEFLERVKANAAKRAEAKAQGVAVQLKRQPAQPRES
RIVSTEGNVPQTLAPVPYETFI YCL035C, 833 bp, CDS: 501-833 (SEQ ID NO 65)
CCGAAAGAAACCCCATGTTCTTGTTTTGCCTGCCTCCAATGCTTTATCACTCTCTCACACTGTCACAAT
CGTGTTGTCTTCATCCTTAGAAAGGATACCACATTGATAAACAACATATATAAAGTTTAACTATTACCT
TGATCACTTTACACGTCAAGGTCAAAACAGTTTCATAGTTATCACCTTGAAGTATGGCTCCATCATCTA
TAAAACATGAACTTCATGCACAAGTGAGCTGTCTACAGATAACGAGCAGCCGCAACGGCGTTTCCAGAT
TGCGATGCTTGTTTTCTTTATCTACTACTGCCTTACTACCCCCCTTGCGCCTCCTGATTCACGTGATGT
GGGAATTTTGTCTTGAAAGGAGTAAATATATAAAATAAATGAAAAGTTTATATAATATAAAAAGGGACT
TTAGCATAAAATAAAGAACTTCGTGCAGTACTTATACGAGCATTCGCATAATTATACAAATAGACAAAA
CCTCAGAAGGAAAAAAATGGTATCTCAAGAAACTATCAAGCACGTCAAGGACCTTATTGCAGAAAACG
AGATCTTCGTCGCATCCAAAACGTACTGTCCATACTGCCATGCAGCCCTAAACACGCTTTTTGAAAAGT
TAAAGGTTCCCAGGTCCAAAGTTCTGGTTTTGCAATTGAATGACATGAAGGAAGGCGCAGACATTCAGG
CTGCGTTATATGAGATTAATGGCCAAAGAACCGTGCCAAACATCTATATTAATGGTAAACATATTGGAG
GCAACGACGACTTGCAGGAATTGAGGGAGACTGGTGAATTGGAGGAATTGTTAGAACCTATTCTTGCAA
ATTAA YCL035C, 110 aa (SEQ ID NO 66)
MVSQETIKHVKDLIAENEIFVASKTYCPYCHAALNTLFEKLKVPRSKVLVLQLNDMKEGADIQAALYEI
NGQRTVPNIYINGKHIGGNDDLQELRETGELEELLEPILAN YDL004w, 983 bp, CDS: 501-983 (SEQ ID NO 81)
ATAAACATAAGATATAATAGTTTTTAAAATGGTCAACGTATGCGATGCACAACTAAAAGGTACCAATTC
ATTAAATATTATAATATTTACTTCTTACTATTACACGAAAGACAAGTGTGAAATGCCTAGGAGATTGAT
GATTGACAAGCTCTGGCCTTGCAATAAAAATACTTATACACAACTTCAAATAATATAGAAAAGAAAGAA
GACTATAAGCTAAAAATGTAGACAACCTCATTTAAATATTATTCTTAGGACTTGGTAATAATAGCTAAT
TTGTATATTATTCACCTCGGTCACCGCCTGTAATCACCTTTAACGAAAATAGATGCCCAGCCAATCAAA
GCGCATTATGGAGTCGTCTAGGAAGGGGCCGTCCCATCATTGTAAAAGTTCATGTTAAATTAGATGGAG
GATAACAATAAAGGTATCGTACACACACTGCTAAAAGAGCCTCAATCAATTTGTGAAGGTATAACTGTA
GCCGTGAGGATAGGAAAATGTTACGTTCAATTATTGGAAAGAGTGCATCAAGATCATTGAATTTCGTCG
CTAAGCGTTCATATGCAGAAGCTGCTGCCGCATCATCAGGTTTGAAGTTACAATTTGCTCTACCACACG
AAACTTTATATAGTGGCTCCGAAGTTACTCAAGTGAACCTGCCTGCTAAGTCAGGACGTATTGGTGTAT
TGGCCAACCATGTTCCCACCGTTGAACAATTACTACCAGGTGTCGTTGAAGTTATGGAAGGCTCTAACT
CTAAAAAATTCTTTATATCAGGTGGATTTGCAACAGTTCAACCAGACTCGCAGTTATGTGTAACTGCAA
TTGAAGCTTTTCCATTGGAATCCTTTTCACAAGAAATATAAAAAATTTGTTGGCAGAAGCTAAGAAGA
ACGTTAGTTCATCTGATGCCAGGGAAGCCGCAGAAGCTGCAATTCAAGTAGAAGTTTTAGAAAACCTAC
AATCCGTATTGAAATAG YDL004W, 160 aa (SEQ ID NO 82)
MLRSIIGKSASRSLNFVAKRSYAEAAAASSGLKLQFALPHETLYSGSEVTQVNLPAKSGRIGVLANHVP
TVEQLLPGVVEVMEGSNSKKFFISGGFATVQPDSQLCVTAIEAFPLESFSQENIKNLLAEAKKNVSSSD
AREAAEAAIQVEVLENLQSVLK YDL075W, 1263 bp, exon1: 501-557, intron1: 558-978, exon2: 979-1263
(SEQ ID NO 85)
ACTATATTTTGTTTTCCCGAACCTCTCCCCTTCTGGGCCCTTTTTCCATTATTCACAATATTTTCATAC
CTTTACCTCCGTACACCAATCTTTATTTTTACCCCCATACCTTTGTATTCTGAAATTGAGAAATGATTT
GTGGTGCTTTTTTTTTTGGACAATCTGCCTTCGTGGACAGTTTTGAAACGCTAGGCGACAGTTTTGCAA
CGGAAGGAAGTGGGAGAGCCCAGAAAGGCTTTCTCTCGATGGTGGATCATTCTTGCGCAGGCGGAGGAT
GGGAAAGCTCCGTTCAGGTTTGCGGCTTTTCTTTCTGGCATTTTCGTTCTCCCAACTGCGCAGGCAGAC
ATAGCTTGACTTTACTCATGCTCGCATTAGGCGGGTTGAATCTCATAGCTTGAAAGATAGTATTGAATT
ATATTGAAGATTTTATAACTAGTGATAATTTCATTCAAGTTTTAAAGAAAGAATTAATAAGCAAACAGA
ACTCAATCAAAGGAAAAATGGCCGGTTTGAAAGACGTTGTCACTCGTGAATACACCATTAACTTGCACA
AAAGAGTATGTGAAAGAATAAAAATATAATGCCCAAGGGCTTGTCATCTGAATGGTTAATTAAGAAGAT
ATTTCTATAGTCAAGGAATACAATATCAAGAATTTGTACCACAGAAACCTATCAACAAAGATCATTGAT
CAAGATATATTTTATAATACGGAATTTGAAGACCATAATCAATATTATAACATCCAAGAGGGGAAAGAT
ACACTTCGGCTGGACTTAAAGAGCGATGAAGACAGAAATAGTTATCTTAAATAGTGGAATCCTAGATTT
TAAGTCGACAATTATCCATATCCCAAGTTTGACTAAATATGAATCAGAACAAATTGGGTCTCCAATATA
CAAAACCATTCATCAAGATTACACTAATATTAAAATGAACAATCGTTACTAACAAAAAATTTACCATTT
TATTTTTAATAGTTGCACGGTGTCTCCTTCAAGAAGAGAGCTCCAAGAGCTGTCAAGGAAATTAAGAAG
TTCGCCAAGTTACACATGGGTACTGATGATGTCCGTCTAGCTCCAGAATTGAACCAAGCTATCTGGAAG
AGAGGTGTCAAGGGTGTTGAATACAGATTAAGATTGAGAATTTCCAGAAAGAGAAACGAAGAAGAAGAC
GCCAAGAACCCATTGTTCTCCTACGTTGAACCTGTCTTAGTTGCTTCTGCCAAGGGTCTACAAACTGTT
GTTGTCGAAGAAGATGCTTAA YDL075W, 113 aa (SEQ ID NO 86)
MAGLKDVVTREYTINLHKRLHGVSFKKRAPRAVKEIKKFAKLHMGTDDVRLAPELNQAIWKRGVKGVEY
RLRLRISRKRNEEEDAKNPLFSYVEPVLVASAKGLQTVVVEEDA YDR064W, 1495 bp, exon1: 501-521, intron1: 522-1060, exon2: 1061-1495
(SEQ ID NO 89)
TGACGGTCGTTTCACAGGAATGGAAGATGCTTTATGCCGGCGCATTAGAAATGATCAGAGAGGAGTGCG
GTACTTTTAAATTGATAGAGGTTTCTTCAGGTTTGGAGGATGACTCAGACGTTGAAGAATTGAGGGAGC
AATTAGAAAATTGTTAGTATAGTCTATCTTAAACACTAAACTACCTCCTATAATCATGTAGTGTACTTT
AAACATTTTTTTTATCTTCATAGCAATAATATAAGCCTTTTACCACCCATAAACCATAAAGTAGACCCAA
ACATTTTTAAAAAAATTTTACGTTATAATTTTTTCTTTGTCGTTTTTTCTGAGCGCGCAAAGTAGCGGT
GAAATTTTGATACGAATGAGATTTCCACTTCTGTACAGATGGAAATTTATGTTGGCCGACATATATCAC
AGTCGTGATTGAATTAACAATTTCTTTCTCATTAATATTTATTCTAAACGGTTAACCACTAAATCAATC
AACAACAATCAGTCAAAATGGGTCGTATGCACAGTGCCGTATGTTTATTAACACCATAGCGAGATATTA
ATGCAAAAGTTGCATTGAATAGTTCGCTAAATCAGATGACACTCTAATGTGGAATTCAAAAGTGGATTT
CTAATATAATTTGTCTCTGTCGGATCACAATTCTATTACAAGTTCCGGTGTGTACACAGGTATAGTTTA
TACTGGAGAGTAGTTTCTACTCGCTGTACATTAGCTGGGTGATTCCAATTTCTTTTACAAATATGTTGC
ATTAGTTTAACAGGTTATACTATCTGCCGTTTCTCAGTATAATTTACGCCGGAAAATTACTGATGGCTA
GCCGCCTTTATGAATTAGTTTTCACAAAGCTCATAACATAACACGTTAACCTATCGGAGGAGAACCAAG
ATTGAAGAATCACCCGGAATAGTTATACTTTAATGGAATTGTATGGTCTGAACGAGGAAATATGTCATG
ATACACTTTTCTTCAAGCCATATGAATCTTCATGTTACTAACATTCGATAAATTTTTTGGAATATCCAA
TTCCACTAAATATTACTTTAAACAGGGTAAAGGTATTTCTTCTTCTGCTATTCCATACTCTAGAAATGC
TCCAGCTTGGTTCAAGTTGTCCTCTGAATCTGTCATTGAACAAATTGTCAAGTACGCGAGAAAGGGTTT
GACTCCATCTCAAATTGGTGTCTTGTTGAGAGATGCTCACGGTGTTACCCAAGCTCGTGTTATCACTGG
TAACAAGATCATGAGAATCTTGAAGTCCAATGGTTTGGCTCCAGAAATCCCAGAAGATTTGTACTACTT
GATTAAGAAGGCTGTCTCTGTTAGAAAGCACTTGGAAAGAAACAGAAAGGACAAAGACGCTAAGTTCAG
ATTGATTTTGATCGAATCTAGAATTCACAGATTGGCCAGATACTACAGAACTGTTGCTGTCTTACCACC
AAACTGGAAGTACGAATCCGCCACTGCCTCCGCTTTGGTCAACTAG YDR064W, 151 aa (SEQ ID NO 90)
MGRMHSAGKGISSSAIPYSRNAPAWFKLSSESVIEQIVKYARKGLTPSQIGVLLRDAHGVTQARVITGN
KIMRILKSNGLAPEIPEDLYYLIKKAVSVRKHLERNRKDKDAKFRLILIESRIHRLARYYRTVAVLPPN
WKYESATASALVN YDR099W, 1322 bp, CDS: 501-1322 (SEQ ID NO 93)
TTGTTACGACCAATCCGTAATTCAAGCGTGGGTATTCATATGACCAGAGATAATAATACAGCGAATACT
ATTGAAATCGTCCCTTTTTTGTTTAGGAAGAACGGACAAATCGGTCGTCTGCTCGAAATGATTAGTAGT
GTGTCACCCGGATCAGCAAAATGACACACACGAAATACGAGGAAAAAGTCGGTCGAAAGGGGCAAATGT
TATTATAAGTCCCTCCAGTAGTCTTTTTTTTTTCAAATATTCATCATCAAAGGTTACGAAATCTTTTGA
GCTATCTTAAACATTCGTTCTTTTTATCAAATTTCAATTACTAACTTATTTTTTCAAAAAAAATTGCCT
CTCCCGGTTTTTAATCATTATTTTTTTCGATTGATTAAGGGGGAAAAGCAAAGAACGAGAAAACTTGGA
CAGAAGGTTAATACTCTGACAATTTCAAAACGAAGTAAAAAGAAAAATTATCAAATCAACAAAAAGTAC
CCGTTACAACAAAAAAAATGTCCCAAACTCGTGAAGATTCTGTTTACCTAGCTAAATTAGCTGAACAAG
CCGAACGTTATGAAGAAATGGTCGAAAACATGAAGGCCGTTGCTTCATCAGGTCAAGAGTTATCTGTCG
AAGAACGGAATCTATTGTCGGTTGCTTACAAGAACGTCATCGGTGCTCGCCGTGCTTCATGGAGAATAG
TTTCTTCGATCGAACAAAAAGAAGAATCAAGGAGAAATCTGAACATCAAGTTGAATTAATCCGTTCTT
ACCGTTCTAAAATTGAAACTGAATTGACCAAAATCTCTGACGACATTTTATCTGTGTTAGATTCTCATT
TAATCCCTTCTGCTACTACTGGTGAGTCTAAAGTATTTTACTATAAGATGAAGGGTGACTACCACCGTT
ATTTAGCTGAATTTTCCAGCGGAGATGCAAGAGAAAAGGCAACCAACTCCTCTTTGGAGGCTTATAAAA
CCGCTTCCGAAATCGCCACAACTGAATTGCCTCCAACTCACCCAATTCGTTTAGGTCTAGCTTTGAATT
CTCCGTCTTCTATTACGAAATTCAAAACTCTCCTGATAAGGCTTGCCACTTGGCCAAACAAGCCTTTG
ATGATGCTATTGCTGAGTTAGATACTTTATCTGAAGAATCATACAAGGATAGCACTTTGATCATGCAAT
TATTAAGGGACAACTTGACCTTATGGACCTCTGATATTTCTGAATCTGGTCAAGAAGATCAACAACAAC
AACAACAACAGCAACAGCAACAGCAACAACAGCAACAACAAGCTCCAGCTGAACAAACTCAAGGTGAAC
CAACCAAATAA YDR099W, 273 aa (SEQ ID NO 94)
MSQTREDSVYLAKLAEQAERYEEMVENMKAVASSGQELSVEERNLLSVAYKNVIGARRASWRIVSSIEQ
KEESKEKSEHQVELIRSYRSKIETELTKISDDILSVLDSHLIPSATTGESKVFYYKMKGDYHRYLAEFS
SGDAREKATNSSLEAYKTASEIATTELPPTHPIRLGLALNFSVFYYEIQNSPDKACHLAKQAFDDAIAE
LDTLSEESYKDSTLIMQLLRDNLTLWTSDISESGQEDQQQQQQQQQQQQQQQQAPAEQTQGEPTK YDR134C, 701 bp, CDS: 501-701 (SEQ ID NO 97)
GGAGTTTTCCTATTTCGAATTGATGGCTGGGTTTGAGCTGCAGGACACGCTGCAGTGGGGAAGCCCTTT
TAAATCCGCGAGTCCGGTCCGTGCTCACTTTTAGACGCGTGTTCCATCGGCGTTCGGATGGTTTCCAGT
GAGAAAAGGGGCTACGCGTATGGTCGGTAGTCCCTTTCAGGGACCAGTGCAGAGGGTGAATCAACGGCC
CCTTCACAGAAACCGCGCAGGAATTTTTCTGGTGTTTGTTATTTTTTTTCCTTGTACTTATCTCACTT
TTCTTTTTCTAACTATTTTTTTGCAATTTTTTGTGTACACTTTCCACAACATATAGGATGGTTTAGT
CATCTCTCGAAGTATATAAACCGTTGCTGGATCGTGGTTGTTCTTCATCGACTTCTCTCTGCTAGACTC
TCTTTTTTAAAATTTTTTCATAGAATAAAAAACCAAGGATAACAAACATCTTCTTTCGTTCGCTTCAAA
ATAACTACAAATTAAAAATGCAATTCTCTACCGTCGCTTCTATCGCTGCTATTGCCGCTGTTGCCTCCG
CCGCTTCTAACATTACCACTGCTACTGTCACAGAAGAATCTACCACTTTGGTCACTATCACTTCTTGTG
AGGACCACGTTTGTTCTGAAACAGTTTCCCCAGCTTTGGTTTCCACTGCTACCGTCACCGTAAATGACG
TTATCACTTAA YDR134C, 66 aa (SEQ ID NO 98)
MQFSTVASIAAIAAVASAASNITTATVTEESTTLVTITSCEDHVCSETVSPALVSTATVTVNDVIT YDR171W, 1628bp, CDS: 501-1628 (SEQ ID NO 103)
CTGGGGTTGGGTAACAAGTGAGCAAGGGAAAAAGTGAACATTTTAAGAAGAACAATAAAATAGCAAGAG
ATGGAATGGTAATGCTTGGCTCTCGAGAAGAGTAGCATAAAACGAGACTTGTTTAAAACAGGATATGAC
ATACTTCAATTCAGCTTTCCCTATCAGCCGCTCGAGCAGTTATATAGGTGTGTTGCCGGAGTAATTTGG
CGGAGGCCAACAGTGGCTAGGCGGCAACGCCTGGAACACGCGCTTAAAAGTTCTGGAAGGTTCGCGAAT
TGAGAACTGCTCAGGGGCGAATACAGGGGCGGCCTTGGCGGCAGGGGGAGGCCTCTGTGAAGTTAGTT
ATATAAGACTTGCTGTCATCGTTTTTTTGATCCCGGCAGGAACTATCTTTTATTCTCATACATACGGTC
AAGAAGTATAATTATACATAACATAGGGACACGTTCAGGCAATTGTCCATATCCCACACAAATTAAGAT
CATACCAAGCCGAAGCAATGAGTTTTTATCAACCATCCCTATCTCTTTATGACGTTTTGAACGCATTAT
CCAACCAAACTGGCCAGAGAGGGCAGCAAGGATATCCTCGCCAACCACAAAGGCCACAGAGATACCATC
CCCATTATGGACAAGTGCACGTTGGCGGGCATCATCCTCGTCATCATCCATTGTATAGCAGATACAATG GTGTTCCTAATACCTATTACTACCAGTTCCCTGGACAAGCCTATTACTATAGTCCTGAATACGGTTATG
ATGACGAGGATGGTGAAGAAGAGGACCAAGACGAAGATATGGTGGGTGACAGCGGCACTACAAGACAGG
AAGATGGTGGCGAGGACAGCAACTCGAGAAGATATCCATCATATTACCATTGTAATACTGCCAGGAATA
ATAGGACCAACCAACAGGCAAACAGTTTAAACGACTTATTAACCGCGTTAATAGGTGTTCCACCATATG
AAGGCACTGAACCAGAAATTGAAGCAAATACCGAACAGGAGGGCGAAAAGGGAGAAGAAAAGGATAAGA
AGGATAAGTCTGAAGCACCCAAAGAGGAAGCTGGCGAAACCAACAAAGAAAAACCTTTGAATCAGCTGG
AGGAATCGTCGAGACCACCATTAGCCAAAAAATCTTCATCGTTCGCTCACCTACAAGCGCCTTCCCCAA
TACCTGACCCGTTACAAGTATCCAAGCCTGAAACGAGAATGGACTTACCATTTTCACCAGAAGTGAATG
TCTATGATACCGAGGACACTTACGTAGTTGTTCTTGCGTTACCAGGTGCTAACTCTAGGGCTTTCCACA
TTGATTACCATCCATCTTCTCATGAGATGCTCATCAAGGGTAAGATCGAAGACAGAGTGGGCATTGATG
AAAAATTCTTGAAGATCACGGAACTAAAATATGGTGCGTTTGAGAGAACCGTTAAATTCCCCGTGCTGC
CACGCATTAAGGACGAAGAAATTAAAGCTACTTACAACAACGGTCTACTACAAATTAAGGTGCCTAAAA
TTGTCAATGACACTGAAAAGCCGAAGCCAAAAAAGAGGATCGCCATTGAGGAAATACCCGACGAAGAAT
GGAGTTTGAAGAAAATCCCAACCCTACGGTAGAAAATTGA YDR171W, 375 aa (SEQ ID NO 104)
MSFYQPSLSLYDVLNALSNQTGQRGQQGYPRQPQRPQRYHPHYGQVHVGGHHPRHHPLYSRYNGVPNTY
YYQFPGQAYYYSPEYGYDDEDGEEEDQDEDMVGDSGTTRQEDGGEDSNSRRYPSYYHCNTARNNRTNQQ
ANSLNDLLTALIGVPPYEGTEPEIEANTEQEGEKGEEKDKKDKSEAPKEEAGETNKEKPLNQLEESSRP
PLAKKSSSFAHLQAPSPIPDPLQVSKPETRMDLPFSPEVNVYDTEDTYVVVLALPGANSRAFHIDYHPS
SHEMLIKGKIEDRVGIDEKFLKITELKYGAFERTVKFPVLPRIKDEEIKATYNNGLLQIKVPKIVNDTE
KPKPKKRIAIEEIPDEELEFEENPNPTVEN YDR399W, 1166 bp, CDS: 501-1166 (SEQ ID NO 129)
TCGTTTATCCTTTTTGAACTGCATCTGGCATCGTTAACAGTAAGGCCATCTGGAACATCAAGCAAGCAC
TCCACTTTTACGTCACAACCATAGTTGGTTAACTAAGAAAAGACAGTACATATTTCCCTTCCGAGTCAC
TTATTTTTTTTTTTCTTCTGAAAAAATTAATTAGATTAATTTCAATTAATATCATTTCCGCTTATCTGAC
TTCTTTCATTTTTTTTCTCTATATTTCGCGTTTACTAGGAAAGAAAAGGAAAAAAAATTTTTCCCCCTC
CATCTGTCCCAAATCGGGTAGCGATGAGCTGCTATAGAATTTTCTATTTAAACATGTTTGATAAGCCCA
ATTTCCGTTAGATTTTGTTCCCCCTTCGCAGTTTGGTTTGCCGTAACTTTTTTATTTTAGTCTCCATCT
AGCTGGAGTAATACGATGTAGTGCCTTGTAATCTTTCTTATTTTTATATTACCGTTCGTGTTCATTATA
TCCATTACGTTCCCATAATGTCGGCAAACGATAAGCAATACATCTCGTACAACAACGTACATCAACTAT
GTCAAGTATCCGCTGAGAGAATTAAGAATTTCAAGCCGGACTTAATCATTGCCATTGGTGGTGGTGGTT
TCATTCCTGCTAGGATCCTACGTACGTTCCTAAAGGAGCCCGGCGTGCCAACCATCAGAATTTTTGCTA
TTATTTTGTCTTTGTACGAAGATTTGAACAGTGTAGGCTCAGAAGTTGAGGAAGTTGGTGTTAAGGTTA
GCAGAACACAATGGATTGATTACGAGCAATGTAAATTAGATCTAGTCGGCAAGAACGTTCTTATCGTTG
ACGAAGTCGATGACACCCGTACCACACTTCATTACGCTTTGAGTGAATTGGAAAAGGATGCAGCTGAAC
AGGCAAAGGCTAAAGGTATCGATACTGAAAAGTCTCCAGAGATGAAAACAAACTTCGGGATTTTTGTTC
TACACGATAAGCAAAAACCAAAGAAAGCAGATTTGCCTGCCGAAATGTTGAATGACAAGAACCGTTATT
TTGCAGCTAAAACTGTTCCAGACAAGTGGTATGCATATCCATGGGAATCTACTGACATTGTTTTCCATA
CTAGAATGGCTATTGAACAGGGCAATGACATCTTTATTCCTGAGCAGGAACACAAGCAATGA YDR399W, 221 aa (SEQ ID NO 130)
MSANDKQYISYNNVHQLCQVSAERIKNFKPDLIIAIGGGGFIPARILRTFLKEPGVPTIRIFAIILSLY
EDLNSVGSEVEEVGVKVSRTQWIDYEQCKLDLVGKNVLIVDEVDDTRTTLHYALSELEKDAAEQAKAKG
IDTEKSPEMKTNFGIFVLHDKQKPKKADLPAEMLNDKNRYFAAKTVPDKWYAYPWESTDIVFHTRMAIE
QGNDIFIPEQEHKQ YDR418W, 998 bp, CDS: 501-998 (SEQ ID NO 131)
TGCACTGTGGATGTTTGGGTTGTGTATTTTGCTTTCATAACATACAGATATTTTGTTTAAGGAAGTGAA
ATAAACAATATCATAAAACAGGTACTTCATAGACCATAAAGCATAACCCAGATTATCCTCTTAGATAGC
AATGCTAATGTAAACAGAGATCCGTTTGCGTGACTTTATACTAATATGATATGTCTACTTCGCTTTGTG
TTCGAGCAGCCTGGCAGTCCCCTCTAGCCGCTTTTTTCCCTTTCCGAAGGTTTCCGCCTAAGCCCCCTG
GCTCTAGGCCGAGAAAATGTTAATGCTCCTTCTACGAGAAATGCTTGTCGCCACACCAGGACAGGTGC
TCGACGACGCTTCCGCTAATCTTTCTCAATGTTGTATCTTCTTTGGCGGTACATTACTAGTATGAAAAT
GGAATAAAAACAGTACCTAAATTATTTACTTACTTCCCGTTAAAGCAACCCCAAGTGCCCAATAGAAGG ATAAATCAATAGTCAATATGCCTCCAAAGTTTGATCCAAATGAAGTTAAGTACTTGTACTTGAGAGCTG
TCGGTGGTGAAGTCGGTGCTTCCGCCGCCTTGGCTCCAAAGATCGGTCCATTGGGTTTATCCCCAAAGA
AGGTTGGTGAAGATATCGCCAAGGCCACCAAGGAATTCAAAGGTATCAAAGTTACTGTCCAATTGAAAA
TCCAAAACAGACAAGCTGCTGCTTCTGTTGTTCCATCTGCTTCCTCTTTGGTCATTACTGCTTTGAAGG
AACCACCAAGAGACAGAAAGAAGGATAAGAACGTCAAGCATAGCGGTAACATCCAATTGGATGAAATTA
TTGAAATTGCCAGACAAATGAGAGACAAATCCTTCGGTAGAACTTTGGCTTCCGTTACTAAGGAAATTT
TGGGTACTGCTCAATCTGTCGGTTGTCGTGTTGATTTCAAGAACCCTCATGACATCATTGAAGGTATTA
ACGCTGGTGAAATTGAAATTCCAGAAAACTAA YDR418W, 165 aa (SEQ ID NO 132)
MPPKFDPNEVKYLYLRAVGGEVGASAALAPKIGPLGLSPKKVGEDIAKATKEFKGIKVTVQLKIQNRQA
AASVVPSASSLVITALKEPPRDRKKDKNVKHSGNIQLDEIIEIARQMRDKSFGRTLASVTKEILGTAQS
VGCRVDFKNPHDIIEGINAGEIEIPEN YDR513W, 932 bp, CDS: 501-932 (SEQ ID NO 133)
TCTCCCTCTCCTGCCATATAACCCCACTGGTATTTTCCAATGCCTTATTGTTGGAAACCTGATCTTTAT
ACCATTCCTGCACTTTCACAGGGTCATTGCCGTGGATAATACAAAACTTGAATTTGGACACCTGCTTGT
CACATGATGTAAAATCTCCATATCTGTAATAGCTTCTAAATTGCCCTCCAATCGAATAGCAACTCGTCA
GTTGATCAAATGCCTCTCGGCAACTCATCGTTGTCGGATATTTTGTACTCATCCTTTCCTGTTTCTTCC
TCAAGCTGCTCTCTTTTACCCTAATAGAACCATCGCCTCCCTCTTGATTTATGCTAATACCACATCCAA
TAGCAGAACTATTACTAAGATCCGATATTTCGGCCCCCTTCGCAAAGGGGCCCGCCGCACTTTCTTCAT
GAATTTTCATATAAAAAGTCCCAGGACGCCAAGAAAAGGTGCCCTCTTGATTAACGGACACTCCAACTA
CTGTTATATATTGTTTCATGGAGACCAATTTTTCCTTCGACTCGAATTTAATTGTTATTATCATTATCA
CGTTGTTTGCCACAAGAATTATTGCTAAAAGATTTTTATCTACTCCAAAAATGGTATCCCAGGAAACAG
TTGCTCACGTAAAGGATCTGATTGGCCAAAAGGAAGTGTTTGTTGCAGCAAAGACATACTGCCCTTACT
GTAAAGCTACTTTGTCTACCCTCTTCCAAGAATTGAACGTTCCCAAATCCAAGGCCCTTGTGTTGGAAT
TAGATGAAATGAGCAATGGCTCAGAGATTCAAGACGCTTTAGAAGAAATCTCGGGCCAAAAAACTGTAC
CTAACGTATACATCAATGGCAAGCACATTGGTGGTAACAGCGATTTGGAAACTTTGAAGAAAAATGGCA
AGTTAGCTGAAATATTGAAGCCGGTATTTCAATAG YDR513W, 143 aa (SEQ ID NO 134)
METNFSFDSNLIVIIIITLFATRIIAKRFLSTPKMVSQETVAHVKDLIGQKEVFVAAKTYCPYCKATLS
TLFQELNVPKSKALVLELDEMSNGSEIQDALEEISGQKTVPNVYINGKHIGGNSDLETLKKNGKLAEIL
KPVFQ YEL009C, 1346 bp, CDS: 501-1346 (SEQ ID NO 139)
AGTTTCACTAGCGAATTATACAACTCACCAGCCACACAGCTCACTCATCTACTTCGCAATCAAAACAAA
ATATTTTATTTTAGTTCAGTTTATTAAGTTATTATCAGTATCGTATTAAAAAATTAAAGATCATTGAAA
AATGGCTTGCTAAACCGATTATATTTTGTTTTTAAAGTAGATTATTATTAGAAAATTATTAAGAGAATT
ATGTGTTAAATTTATTGAAAGAGAAAATTTATTTTCCCTTATTAATTAAAGTCCTTTACTTTTTTTGAA
AACTGTCAGTTTTTTGAAGAGTTATTTGTTTTGTTACCAATTGCTATCATGTACCCGTAGAATTTTATT
CAAGATGTTTCCGTAACGGTTACCTTTCTGTCAAATTATCCAGGTTTACTCGCCAATAAAAATTTCCCT
ATACTATCATTAATTAAATCATTATTATTACTAAAGTTTTGTTTACCAATTTGTCTGCTCAAGAAAATA
AATTAAATACAAATAAAATGTCCGAATATCAGCCAAGTTTATTTGCTTTAAATCCAATGGGTTTCTCAC
CATTGGATGGTTCTAAATCAACCAACGAAAATGTATCTGCTTCCACTTCTACTGCCAAACCAATGGTTG
GCCAATTGATTTTTGATAAATTCATCAAGACTGAAGAGGATCCAATTATCAAACAGGATACCCCTTCGA
ACCTTGATTTTGATTTTGCTCTTCCACAAACGGCAACTGCCACCTGATGCCAAGACCGTTTTGCCAATTC
CGGAGCTAGATGACGCTGTAGTGGAATCTTCTTTTCGTCAAGCACTGATTCAACTCCAATGTTTGAGT
ATGAAAACCTAGAAGACAACTCTAAAGAATGGACATCCTTGTTTGACAATGACATTCCAGTTACCACTG
ACGATGTTTCATTGGCTGATAAGGCAATTGAATCCACTGACGAAGAAGTTTCTCTGGTACCATCCAATCTGG
AAGTCTCGACAACTTCATTCTTACCCACTCCTGTTCTAGAAGATGCTAAACTGACTCAAACAAGAAAGG
TTAAGAAACCAAATTCAGTCGTTAAGAAGTCACATCATGTTGGAAAGGATGACGAATCGAGACTGGATC
ATCTAGGTGTTGTTGCTTACAACCGCAAACAGCGTTCGATTCCACTTTCTCCAATTGTGCCCGAATCCA
GTGATCCTGCTGCTCTAAAACGTGCTAGAAACACTGAAGCCGCCAGGCGTTCTCGTGCGAGAAAGTTGC
AAAGAATGAAACAACTTGAAGACAAGGTTGAAGAATTGCTTTCGAAAAATTATCACTTGGAAAATGAGG
TTGCCAGATTAAAGAAATTAGTTGGCGAACGCTGA YEL009C, 281 aa (SEQ ID NO 140)
MSEYQPSLFALNPMGFSPLDGSKSTNENVSASTSTAKPMVGQLIFDKFIKTEEDPIIKQDTPSNLDFDF
ALPQTATAPDAKTVLPIPELDDAVVESFFSSSTDSTPMFEYENLEDNSKEWTSLFDNDIPVTTDDVSLA
DKAIESTEEVSLVPSNLEVSTTSFLPTPVLEDAKLTQTRKVKKPNSVVKKSHHVGKDDESRLDHLGVVA
YNRKQRSIPLSPIVPESSDPAALKRARNTEAARRSRARKLQRMKQLEDKVEELLSKNYHLENEVARLKK
LVGER YGL123W, 1264 bp, CDS: 501-1265 (SEQ ID NO 163)
TGGCTTATTCACTAAGGATTCTTAAGGTTTTCTTAATAGTTTTCTACGTCGGCATGCGATTGTTTGGTT
TAGAAGACTGCTTTCTAAATATGGTTGGGTGTATTTAAGCTAGACCCATACACCCGCTCTATGGGATTA
TTTACTTGTTTGAATTTTAAGATTTGTGATAATGGAACTGGACGCAAACATTTGATGGAAAACGCATGT
CATCATTAACGAGGTAACGTAGGTATCTGTCCTGCCTTAGTATTGCACGCAGCTTCCCAGGACGCCTAG
CTATTTTTTCATCTATTCCCCTCTGTAGTAACGTAAGAGTTTTCAAGTTTTTAATTCAGACTTTCTCTT
CCTTTGTTTCCAATTTCCTTCCTTACTGCTTGATACCTTTTCAATCCCAAAGAAACCGTGTTCTTTATA
TATTGTCGATTGAAAGTTACCTACATCAACTTTCGTGTTCCATTCCGACTATAACAAACAACCAATAA
GCTCAACTAATTAAGTAATGTCTGCTCCAGAAGCTCAACAACAAAGAGAGGTGGTTTCGGTGGCCGTA
ACAGAGGCCGTCCAAACAGAAGAGGACCAAGAAACACTGAAGAAAAGGGATGGGTTCCAGTTACCAAAC
TAGGTAGATTAGTCAAGGCTGGTAAGATTACCACCATTGAAGAAATCTTCTTGCACTCTTTGCCAGTCA
AGGAATTCCAAATCATTGACACTTTGTTGCCAGGTTTGCAAGACGAAGTCATGAACATCAAGCCAGTTC
AAAAGCAAACCAGAGCCGGTCAAAGAACCAGATTTAAGGCTGTTGTCGTTGTTGGTGACTCTAACGGTC
ACGTTGGTTTGGGTATCAAGACCGCCAAGGAAGTTGCTGGTGCCATCAGAGCTGGTATCATTATTGCCA
AGTTGTCCGTTATCCCAATCAGAAGAGGTTACTGGGGTACCAACTTGGGTCAACCACATTCTTTGGCCA
CCAAGACCACTGGTAAGTGTGGTTCCGTCACTGTTAGATTGATCCCAGCCCCAAGAGGTTCTGGTATCG
TCGCTTCTCCAGCTGTCAAAAAGTTGTTGCAATTGGCTGGTGTTGAAGATGTCTACACCCAATCTAACG
GTAAGACTAGAACTTTGGAAAACACCTTGAAGGCTGCTTTCGTTGCTATTGGTAACACATACGGTTTCT
TGACTCCAAACTTGTGGGCCGAACAACCATTGCCAGTTTCTCCATTGGACATCTACTCCGATGAAGCTT
CTGCTCAAAAGAAGAGATTCTAA YGL123W, 254 aa (SEQ ID NO 164)
MSAPEAQQQKRGGFGGRNRGRPNRRGPRNTEEKGWVPVTKLGRLVKAGKITTIEEIFLHSLPVKEFQII
DTLLPGLQDEVMNIKPVQKQTRAGQRTRFKAVVVVGDSNGHVGLGIKTAKEVAGAIRAGIIIAKLSVIP
IRRGYWGTNLGQPHSLATKTTGKCGSVTVRLIPAPRGSGIVASPAVKKLLQLAGVEDVYTQSNGKTRTL
ENTLKAAFVAIGNTYGFLTPNLWAEQPLPVSPLDIYSDEASAQKKRF YGR209C, 815 bp, CDS: 501-815 (SEQ ID NO 187)
AACATCCAGACTTTTACGGGTGGCAACGGAACCAACGTATTTAGAGATTGTTTTTTGGTCAAGCGAGGA
ACCCCTGTTGGCAAAGTTGCCAGGTATATCATGGGTGGCGAGGTCACCATTGCAAGCATTGAAACCGTT
GGCGGCGTGAGAGTCAGTGAAGAAAGTCTTGTTGAGCCCGGTAAGAATGACATACTCGGCTTCAAGATC
GCTCCAAGATCAGCATAACTTGAGTGCCAGTGAATATTAAGTAATCATCAAAGTATATGTGTAATTGTT
TATACTCTTAGTAAAGGATGCTCCCTACAAGGTGGCTCTTTTCTTACTAAGCGCGTTCAGTTTCCAGCC
AGCCGAAAGAGGGATATCAGTATATAAGAAAGCCATTCGGGGGATGAAAAGCTGACAAGAGAATAACGA
GGACCAGTTTTTATTTGTTGTCTAGCAAGAATTATACACGCACACATACACGAGAGTCTACGATATCTT
TAAATAACACATCAATAATGGTCACTCAATTAAAATCCGCTTCTGAATACGACAGTGCTTTAGCATCTG
GCGACAAGTTAGTCGTTGTTGACTTTTTTGCCACATGGTGTGGGCCATGTAAAATGATTGCACCAATGA
TTGAAAAGTTTGCAGAACAATATTCTGACGCTGCTTTTTACAAGTTGGATGTTGATGAAGTCTCAGATG
TTGCTCAAAAAGCTGAAGTTTCTTCCATGCCTACCCTAATCTTCTACAAGGGCGGTAAGGAGGTTACCA
GAGTCGTCGGTGCCAACCCAGCTGCTATCAAGCAAGCTATTGCTTCCAACGTATAG YGR209C, 104 aa (SEQ ID NO 188)
MVTQLKSASEYDSALASGDKLVVVDFFATWCGPCKMIAPMIEKFAEQYSDAAFYKLDVDEVSDVAQKAE
VSSMPTLIFYKGGKEVTRVVGANPAAIKQAIASNV YHR039C-B, 1007 bp, exon1: 501-503, intron1: 504-665, exon2: 666-1007
(SEQ ID NO 197)
GTACATGCACCATTCGCTTCAACTGCGTCAGATAGTTGTAGTCCCTCTGGACATAAGCATTTCGTTCGT
GCTTGTCGTCGTCCGCCTGTTTCAACGCCTCACTCGATATATACTCCTTAGGATCATGTGTTTGACCTG AGCAATTGTCCCTTGTCTTGTGCTTCTTGGAACACTCCAAAGAGCAAGTTTGCACCAAACATCTTGGAC
ACTTGTATTTGAACTCTTTTATTCCGCATACACCACACAACACCGCCATACTTGCAAATTGCCACACCC
TTCCCTATTAACTGGACTCCTATTCCAGCTCATCTCATCGAATATGAACTTTGACATCCACTATTATTA
CCGCGAATTTTTTTTTTTTCAATTTGTTACCCTGCCTTGGGTATCAAAAATTTCATCTCTAAAAGGGA
GCGTGATAGATAAAGCAATCACACCTTAAACAATACATTTTTTTTTTCCTGCAATCTCCAAAGTGTGC
AAGGTATACAAAGCAGAATGGTATGTGCCATTACATTACGTGTCAACACTTCTGTCTCTAACAAGCGTT
CTTACTAACATGAAAAACTTTTTTAAAACTGTGCTCTCTTGTTGGACTGGTACCTCGTGACAAAGGTAT
TGGTTTTTTCATTGTTGCTCAGAACTATGTAATATTCTCTTTAGTCCCAAAAAAACGGAATTGCCACCC
TACTACAAGCTGAAAAGGAAGCCCACGAAATAGTATCAAAGGCTAGAAAGTACAGACAAGATAAGTTGA
AGCAAGCCAAGACTGATGCAGCCAAGGAAATCGACTCATACAAAATTCAAAAAGACAAGGAATTGAAGG
AGTTTGAACAAAAGAATGCCGGTGGTGTTGGTGAATTGGAAAAGAAAGCAGAGGCTGGTGTGCAAGGTG
AATTAGCTGAGATTAAGAAAATTGCAGAGAAGAAAAAGGATGACGTTGTCAAAATTTTGATCGAGACTG
TCATCAAGCCTTCTGCTGAAGTCCATATCAATGCCTTGTAA YHR039C-B, 114 aa (SEQ ID NO 198)
MSQKNGIATLLQAEKEAHEIVSKARKYRQDKLKQAKTDAAKEIDSYKIQKDKELKEFEQKNAGGVGELE
KKAEAGVQGELAEIKKIAEKKKDDVVKILIETVIKPSAEVHINAL YHR053C, 686 bp, CDS: 501-686 (SEQ ID NO 199)
AACTTCAACGATTTCTATGATGCATTTTATAATTAGTAAGCCGATCCCATTACCGACATTTGGGCGCTA
TACGTGCATATGTTCATGTATGTATCTGTATTTAAAACACTTTTGTATTATTTTTCCTCATATATGTGT
ATAGGTTTATACGGATGATTTAATTATTACTTCACCACCCTTTATTTCAGGCTGATATCTTAGCCTTGT
TACTAGTTAGAAAAAGACATTTTTGCTGTCAGTCACTGTCAAGAGATTCTTTTGCTGGCATTTCTTCTA
GAAGCAAAAAGAGCGATGCGTCTTTTCCGCTGAACCGTTCCAGCAAAAAGACTACCAACGCAATATGG
ATTGTCAGAATCATATAAAAGAGAAGCAAATAACTCCTTGTCTTGTATCAATTGCATTATAATATCTTC
TTGTTAGTGCAATATCATATAGAAGTCATCGAAATAGATATTAAGAAAAACAAACTGTACAATCAATCA
ATCAATCATCACATAAAATGTTCAGCGAATTAATTAACTTCCAAAATGAAGGTCATGAGTGCCAATGCC
AATGTGGTAGCTGCAAAAATAATGAACAATGCCAAAAATCATGTAGCTGCCCAACGGGGTGTAACAGCG
ACGACAAATGCCCCTGCGGTAACAAGTCTGAAGAAACCAAGAAGTCATGCTGCTCTGGGAAATGA YHR053C, 61 aa (SEQ ID NO 200)
MFSELINFQNEGHECQCQCGSCKNNEQCQKSCSCPTGCNSDDKCPCGNKSEETKKSCCSGK YHR055C, 686 bp, CDS: 501-686 (SEQ ID NO 201)
AACTTCAACGATTTCTATGATGCATTTTATAATTAGTAAGCCGATCCCATTACCGACATTTGGGCGCTA
TACGTGCATATGTTCATGTATGTATCTGTATTTAAAACACTTTTGTATTATTTTTCCTCATATATGTGT
ATAGGTTTATACGGATGATTTAATTATTACTTCACCACCCTTTATTTCAGGCTGATATCTTAGCCTTGT
TACTAGTTAGAAAAAGACATTTTTGCTGTCAGTCACTGTCAAGAGATTCTTTTGCTGGCATTTCTTCTA
GAAGCAAAAAGAGCGATGCGTCTTTTCCGCTGAACCGTTCCAGCAAAAAGACTACCAACGCAATATGG
ATTGTCAGAATCATATAAAAGAGAAGCAAATAACTCCTTGTCTTGTATCAATTGCATTATAATATCTTC
TTGTTAGTGCAATATCATATAGAAGTCATCGAAATAGATATTAAGAAAAACAAACTGTACAATCAATCA
ATCAATCATCACATAAAATGTTCAGCGAATTAATTAACTTCCAAAATGAAGGTCATGAGTGCCAATGCC
AATGTGGTAGCTGCAAAAATAATGAACAATGCCAAAAATCATGTAGCTGCCCAACGGGGTGTAACAGCG
ACGACAAATGCCCCTGCGGTAACAAGTCTGAAGAAACCAAGAAGTCATGCTGCTCTGGGAAATGA YHR055C, 61 aa (SEQ ID NO 202)
MFSELINFQNEGHECQCQCGSCKNNEQCQKSCSCPTGCNSDDKCPCGNKSEETKKSCCSGK YHR056C, 2999 bp, CDS: 501-2999 (SEQ ID NO 203)
ATGTATAGTTAAAGGTAAATTAACTAGAGAACGTGGGAACAGTTCCGCACTGTGACCACCGGAACGTAC
GTCTGGTTAGCGCAGCATTAGTCCCAGTTACATCCGATTCAAAATGCAACAGCAAGTATTAATTGGGGA
AATCATATCATTTTGAATATAACCTTGGCGTCCTACTAAGGATGGTTATACATCCTAGCTCGTGTAGTG
TGATATTTTGCAGGAATGATGCAAAGAGAGGAAGAACAAGAAGAGAGTTGTTGTTTTAATGTATCTTA
GCAATTTATGAGAGGAGCATTGTCGTTGTCTGCTGTGACTAGTGCGTAGCTTTGCCGTTTGTTTTTAAT
CATGATGGACATGCAAGTGAGAAAAGTGAGGAAGCCGCCTGCTTGCACCCAATGCAGGAAGAGAAAGAT
CGGGTGCGACAGGGCCAAAACCGATATGTGGGAATTGCGTCAAGTATAACAAGCCGGACTGTTTTATC CAGATGGACCTGGTAAGATGGTCGCTGTGCCCTCTGCGTCCGGGATGTCCACGCACGGCAATGGCCAAG
GTTCCAACCATTTTAGTCAGGGAAACGGTGTAAATCAGAAAAACGTAATGATTCAAACGCAGTATCCGA
TTATGCAAACGTCGATAGAGGCATTCAACTTCTCGTTCAACCCCTCTGTGGATACTGCGATGCAGTGGA
CCAAGGCCGCTAGCTACCAGAATAATAACACCAATAATAATACTGCTCCTCGTCAGAATAGTAGTACCG
TTAGTAGTAATGTTCATGGAAACACTATTGTGAGAAGCGATAGTCCAGATGTGCCCTCCATGGATCAGA
TTAGAGAATATAACACACGATTACAACTGGTTAACGCTCAAAGTTTTGACTATACAGATAACCCATACT
CTTTTAATGTTGGTATCAATCAAGACTCGGCCGTTTTCGATCTAATGACTTCTCCGTTTACTCAAGAGG
AAGTATTAATCAAGGAGATAGACTTTTTAAAAAACAAATTGCTTGATTTACAAAGCTTGCAACTGAAAA
GTTTGAAAGAAAAATCGAATTTAAATGCCGACAATACCACGGCAAACAAAATTAACAAAACAGGTGAGA
ATTCTAAGAAAGGCAAGGTTGACGGTAAAAGAGCCGGATTTGATCATCAGACTTCAAGGACTTCTCAGT
CCTCACAAAAATACTTTACAGCGCTCACAATAACAGATGTGCAAAGTTTAGTCCAAGTGAAACCGTTGA
AGGATACCCCCAACTACCTTTTCACTAAAAACTTCATCATTTTTAGAGATCATTATCTTTTCAAGTTCT
ATAATATTTTGCACGATATCTGCCATATTAATCAGTTCAAAGTAAGTCCTCCTAACAATAAAAATCACC
AACAATATATGGAAGTTTGCAAAGTTAACTTCCCACCAAAAGCAATAATTATTGAGACACTAAACTCTG
AATCCCTTAACAATCTGAATATTGAAGAATTTTTGCCAATCTTTGACAAAACCCTCTTACTAGAATTTG
TTCATAACTCTTTTCCAAATGGTGATACCTGTCCTTCATTCTAACGGTCGATCTTCCTTTATCTCAAC
TGACCAAACTAGGCGAATTAACTGTGCTTCTACTGTTGTTAAACGATTCAATGACCCTATTCAATAAGC
AGGCTATTAATAACCATGTTTCGGCATTAATGAATAATTTGAGGTTGATTCGAAGCCAAATCACATTGA
TAAACCTGGAATATTATGACCAAGAGACAATCAAATTTATTGCCATCACAAAATTTTATGAATCTCTGT
ACATGCATGATGATCATAAATCAAGTTTAGACGAAGATTTGAGCTGTCTGTTAAGCTTCCAGATAAAAG
ATTTCAAGTTATTCCATTTTTTGAAAAAAATGTATTACTCAAGACATTCGCTTCTAGGTCAGTCTTCAT
TCATGGTACCCGCTGCTGAAAACCTATCTCCGATACCTGCCTCTATTGATACGAACGACATTCCTTTAA
TTGCTAACGATTTAAAATTACTGGAAACGCAAGCAAAATTGATAAATATTCTGCAAGGTGTTCCTTTCT
ACTTGCCAGTAAATTTAACCAAAATTGAAAGTCTGTTAGAAACCTTGACTATGGGCGTGAGTAATACAG
TAGACTTATATTTTCATGACAACGAAGTCAGAAAAGAATGGAAAGACACTTTAAATTTTATCAATACCA
TTGTTTATACAAATTTTTTCCTTTTTGTTCAAAACGAATCCTCTTTGTCCATGGCAGTTCAACATTCTT
CTAACAACAATAAGACCTCGAACTCTGAAAGATGTGCAAAGGATCTGATGAAAATTATTTCTAATATGC
ACATTTTTTACTCAATAACATTTAATTTTATCTTCCCCATAAAGTCGATAAAGTCATTTTCAAGCGGCA
ATAATCGCTTTCATTCTAATGGTAAAGAATTTTTATTCGCAAATCATTTTATTGAAATCTTACAGAATT
TTATAGCAATCACATTTGCTATTTTCCAACGTTGTGAAGTAATATTATATGACGAATTTTACAAAAATC
TTTCAAATGAGGAGATTAATGTTCAATTGCTATTGATTCATGACAAGATTTTGGAAATTTTAAAAAAAA
TAGAAATTATCGTATCCTTTTTACGAGATGAAATGAATAGCAACGGAAGTTTCAAATCTATTAAAGGTT
TCAACAAGGTTTTGAATCTGATTAAATATATGCTGAGATTTAGCAAGAAAAAACAAAATTTTGCGAGAA
ACTCTGATAACAATAATGTTACAGATTATAGTCAGTCGGCGAAGAACAAAAATGTTCTCTTGAAATTCC
CCGTTAGTGAACTGAACAGAATCTATTTAAAATTTAAGGAGATTTCAGATTTTTTAATGGAAAGAGAAG
TTGTCCAAAGGAGTATAATTATTGACAAGGATTTGGAATCTGATAATCTGGGTATTACTACGGCAAACT
TCAACGATTTCTATGATGCATTTTATAATTAG YHR056C, 832 aa (SEQ ID NO 204)
MVAVPSASGMSTHGNGQGSNHFSQGNGVNQKNVMIQTQYPIMQTSIEAFNFSFNPSVDTAMQWTKAASY
QNNNTNNNTAPRQNSSTVSSNVHGNTIVRSDSPDVPSMDQIREYNTRLQLVNAQSFDYTDNPYSFNVGI
NQDSAVFDLMTS
PFTQEEVLIKEIDFLKNKLLDLQSLQLKSLKEKSNLNADNTTANKINKTGENSKKGKVDGKRAGFDHQT
SRTSQSSQKYFTALTITDVQSLVQVKPLKDTPNYLFTKNFIIFRDHYLFKFYNILHDICHINQFKVSPP
NNKNHQQYMEVCKVNFPPKAIIIETLNSESLNNLNIEEFLPIFDKTLLLEFVHNSFPNGDTCPSFSTVD
LPLSQLTKLGELTVLLLLLNDSMTLFNKQAINNHVSALMNNLRLIRSQITLINLEYYDQETIKFIAITK
FYESLYMHDDHKSSLDEDLSCLLSFQIKDFKLFHFLKKMYSRHSLLGQSSFMVPAAENLSPIPASIDT
NDIPLIANDLKLLETQAKLINILQGVPFYLPVNLTKIESLLETLTMGVSNTVDLYFHDNEVRKEWKDTL
NFINTIVYTNFFLVQNESSLSMAVQHSSNNNKTSNSERCAKDLMKIISNMHIFYSITFNFIFPIKSIK
SFSSGNNRFHSNGKEFLFANHFIEILQNFIAITFAIFQRCEVILYDEFYKNLSNEEINVQLLLIHDKIL
EILKKIEIIVSFLRDEMNSNGSFKSIKGFNKVLNLIKYMLRFSKKKQNFARNSDNNNVTDYSQSAKNKN
VLLKFPVSELNRIYLKFKEISDFLMEREVVQRSIIIDKDLESDNLGITTANFNDFYDAFYN YJL138C, 1688 bp, CDS: 501-1688 (SEQ ID NO 223)
CTGTTGAATCATGGTAAAAGAGAAAATCAAAAGCACGTTGACCTGGATATAACCTCAGTAGATCGAAAT
GCTTCGCAGAAGAGTACTGCAGAGAAACATGATATTGAGAAACCGACATCTAAGCCGCAATCTGCTTTT AAATTTGATTGGGAGTCTACGGATTATTTAGACCGCGTCCAAAGAGCATTCCCAAAGCCTGATACCTGA
TGCCATCCCTCTACCTCTTAGCTATCAATCATTCAACTAAACTACTACATAGTATACATTAGCTGTACA
GTCGTCACATCAGACGAATACAAAAGGCCGGGTGAAAGCGTTGATTTTGCGTACCTTTTTCTTTTTTTC
GAAATTTTTTTATTTTTTTTTTCAGCATCATATATAAAAGAAATCTCATCTCAAGGAGAAGGAAACAGCA
GATCCCAATACACATAGTAGGAAAAAAAAAGGTTCGCTAAACAAAGGACTGGTGTGTACAAGAAACTAA
TAAATAGTAATTGCAATATGTCTGAAGGTATTACTGATATTGAAGAATCCCAAATTCAAACCAACTATG
ACAAGGTCGTCTACAAGTTCGATGATATGGAATTGGACGAAAACTTGTTAAGAGGTGTTTTCGGTTACG
GTTTCGAAGAACCATCTGCCATTCAACAACGTGCCATCATGCCTATTATTGAAGGTCACGATGTCTTGG
CTCAAGCTCAATCTGGTACTGGTAAGACCGGTACTTTCTCCATTGCTGCTTTGCAAAGAATTGACACCT
CTGTCAAGGCTCCTCAAGCTTTGATGTTGGCTCCAACTAGAGAATTGGCTTTGCAAATCCAAAAGGTTG
TCATGGCTTTGGCTTTCCACATGGACATCAAGGTCCACGCTTGTATCGGTGGTACTTCCTTTGTTGAAG
ACGCTGAAGGTTTGAGAGATGCTCAAATCGTCGTTGGTACTCCAGGTCGTGTTTTTGACAACATCCAAA
GACGTAGATTCAGAACTGACAAGATCAAGATGTTCATCTTAGATGAAGCTGATGAAATGTTGTCTTCTG
GTTTCAAGGAACAAATCTACCAAATTTTCACCTTACTTCCACCAACCACTCAAGTTGTTCTATTGTCCG
CCACCATGCCAAATGACGTCTTGGAAGTTACCACCAAATTTATGAGAAACCCAGTTAGAATTTTGGTTA
AGAAGGATGAATTGACTTTGGAAGGTATCAAACAATTCTACGTTAATGTTGAAGAAGAATACAAAT
ACGAGTGTTTGACCGATTTATACGACTCTATCTCCGTTACTCAAGCTGTCATCTTCTGTAACACCAGAA
GAAAGGTCGAAGAATTGACCACTAAGTTAAGAAACGACAAATTTACCGTTTCTGCCATCTATTCTGATT
TACCACAACAAGAAAGAGACACCATCATGAAGGAATTCAGAAGTGGTTCTTCCAGAATTTTGATCTCCA
CTGATTTGTTGGCTAGAGGTATCGATGTCCAACAAGTTTCTTTGGTTATTAACTACGACTTACCAGCTA
ACAAAGAAAACTATATTCACAGAATCGGTAGAGGTGGTCGTTTCGGTAGAAAGGGTGTTGCCATCAACT
TTGTTACTAACGAAGACGTTGGCGCTATGAGAGAACTAGAAAAGTTCTACTCCACTCAAATTGAAGAAT
TGCCATCCGACATTGCTACCTTGTTGAACTAA YJL138C, 395 aa (SEQ ID NO 224)
MSEGITDIEESQIQTNYDKVVYKFDDMELDENLLRGVFGYGFEEPSAIQQRAIMPIIEGHDVLAQAQSG
TGKTGTFSIAALQRIDTSVKAPQALMLAPTRELALQIQKVVMALAFHMDIKVHACIGGTSFVEDAEGLR
DAQIVVGTPGRVFDNIQRRRFRTDKIKMFILDEADEMLSSGFKEQIYQIFTLLPPTTQVVLLSATMPND
VLEVTTKFMRNPVRILVKKDELTLEGIKQFYVNVEEEEYKYECLTDLYDSISVTQAVIFCNTRRKVEEL
TTKLRNDKFTVSAIYSDLPQQERDTIMKEFRSGSSRILISTDLLARGIDVQQVSLVINYDLPANKENYI
HRIGRGGRFGRKGVAINFVTNEDVGAMRELEKFYSTQIEELPSDIATLLN YKL060C, 1580 bp, CDS: 501-1580 (SEQ ID NO 239)
TGGGTCATTACGTAAATAATGATAGGAATGGGATTCTTCTATTTTTCCTTTTTCCATTCTAGCAGCCGT
CGGGAAAACGTGGCATCCTCTCTTTCGGGCTCAATTGGAGTCACGCTGCCGTGAGCATCCTCTCTTTCC
ATATCTAACAACTGAGCACGTAACCAATGGAAAAGCATGAGCTTAGCGTTGCTCCAAAAAAGTATTGGA
TGGTTAATACCATTTGTCTGTTCTCTTCTGACTTTGACTCCTCAAAAAAAAAAATCTACAATCAACAG
ATCGCTTCAATTACGCCCTCACAAAAACTTTTTTCCTTCTTCTTCGCCCACGTTAAATTTTATCCCTCA
TGTTGTCTAACGGATTTCTGCACTTGATTTATTATAAAAAGACAAAGACATAATACTTCTCTATCAATT
TCAGTTATTGTTCTTCCTTGCGTTATTCTTCTGTTCTTCTTTTTCTTTTGTCATATATAACCATAACCA
AGTAATACATATTCAAAATGGGTGTTGAACAAATCTTAAAGAGAAAGACCGGTGTCATCGTTGGTGAAG
ATGTCCACAACTTATTCACTTACGCTAAGGAACACAAGTTCGCTATTCCAGCTATTAACGTCACCTCTT
CTTCTACTGCCGTCGCTGCTTTAGAAGCTGCTAGAGACAGCAAGTCCCCAATCATTTTGCAAACCTCTA
ACGGTGGTGCTGCTTACTTCGCTGGTAAGGGTATCTCTAACGAAGGTCAAAATGCTTCCATCAAGGGTG
CTATTGCCGCTGCCCACTACATCAGATCCATTGCTCCAGCTTACGGTATCCCAGTTGTCTTACACTCTG
ACCACTGTGCCAAGAAGTTGTTGCCATGGTTCGATGGTATGTTGGAAGCTGATGAAGCTTACTTCAAGG
AACACGGTGAACCATTATTCTCCTCCCACATGTTGGATTTGTCTGAAGAACCGATGAAGAAACATCT
CTACTTGTGTCAAGTACTTCAAGAGAATGGCCGCTATGGACCAATGGTTAGAAATGGAAATCGGTATTA
CCGGTGGTGAAGAAGATGGTGTTAACAACGAAAACGCTGACAAGGAAGACTTGTACACCAAGCCAGAAC
AAGTTTACAACGTCTACAAGGCTTTGCACCCAATCTCTCCAAACTTCTCCATTGCTGCTGCTTTCGGTA
ACTGTCACGGTTTGTACGCTGGTGACATCGCTTTGAGACCAGAAATCTTGGCTGAACACCAAAAGTACA
CCAGAGAACAAGTTGGTTGCAAGGAAGAAAAGCCATTGTTCTTGGTCTTCCACGGTGGTTCCGGTTCTA
CTGTCCAAGAATTCCACACTGGTATTGACAACGGTGTTGTCAAGGTCAACTTGGACACTGACTGTCAAT
ACGCTTACTTGACTGGTATCAGAGACTACGTCTTGAACAAGAAGGACTACATAATGTCCCCAGTCGGTA
ACCCAGAAGGTCCAGAAAAGCCAAACAAGAAGTTCTTCGACCCAAGAGTCTGGGTTAGAGAAGGTGAAA
AGACCATGGGTGCTAAGATCACCAAGTCTTTGGAAACTTTCCGTACCACTAACACTTTATAA YKL060C, 359 aa (SEQ ID NO 240)
MGVEQILKRKTGVIVGEDVHNLFTYAKEHKFAIPAINVTSSSTAVAALEAARDSKSPIILQTSNGGAAY
FAGKGISNEGQNASIKGAIAAAHYIRSIAPAYGIPVVLHSDHCAKKLLPWFDGMLEADEAYFKEHGEPL
FSSHMLDLSEETDEENISTCVKYFKRMAAMDQWLEMEIGITGGEEDGVNNENADKEDLYTKPEQVYNVY
KALHPISPNFSIAAAFGNCHGLYAGDIALRPEILAEHQKYTREQVGCKEEKPLFLVFHGGSGSTVQEFH
TGIDNGVVKVNLDTDCQYAYLTGIRDYVLNKKDYIMSPVGNPEGPEKPNKKFFDPRVWVREGEKTMGAK
ITKSLETFRTTNTL YKL097W-A, 779 bp, CDS: 501-779 (SEQ ID NO 245)
AGCTCCGAAGGGCAATTCCACAGGCACTCCGCGGGGCCCGGCCAAGGCCCAAAAGGCGTGGAATATGCG
CGTTTTGGGGCCATAACACCCAGTACCACGGCCGGAACGGGCCATATAATAAGTTTTTCACTCTCAAGA
ATGGTAAACGTAAATAGGAACATCCCACTACCCTAGAAATTGCGGAAATTTCGCGCTTATCATTAGAAA
ATCTGGAACCGTCCTTTTTCCTCTTTCTTGCATTTCCCTTTCCGTATTATTGCCATTCTTTAACTGCAT
TTGGGGAACCGTAGACCAAAAGCCAAACAGAGAAATGTAACGTTCTAAAAAAAAAACAACGAAAAAATT
GAAAAATAAGATACAATAATCGTATATAAATCAGGCTTCTTGTTCATCATTTTCAATTCTCTTCTTGCC
ATCCCTTTTCCTATCTTTGTTCTTTTCTTCTCATAATCAAGAATAAATAACTTCATCACATTCGCTACA
CACTAACAAGAAAAAAATGCAATTCTCTACTGTCGCTTCCGTTGCTTTCGTCGCTTTGGCTAACTTTG
TTGCCGCTGAATCCGCTGCCGCCATTTCTCAAATCACTGACGGTCAAATCCAAGCTACTACCACTGCTA
CCACCGAAGCTACCACCACTGCTGCCCCATCTTCCACCGTTGAAACTGTTTCTCCATCCAGCACCGAAA
CTATCTCTCAACAAACTGAAAATGGTGCTGCTAAGGCCGCTGTCGGTATGGGTGCCGGTGCTCTAGCTG
CTGCTGCTATGTTGTTATAA YKL097W-A, 92 aa (SEQ ID NO 246)
MQFSTVASVAFVALANFVAAESAAAISQITDGQIQATTTATTEATTTAAPSSTVETVSPSSTETISQQT
ENGAAKAAVGMGAGALAAAAMLL YKL150W, 1409 bp, CDS: 501-1409 (SEQ ID NO 249)
CCCATCACATCGCATCACATCACATCACTCCCTATTCTGCCCTTTACAGCGCAAAGGAGTCGTGTGTGG
GTGTGTGCTCCTTTTGACGATCATAAGAGTCCATTTCTAGTATGCAAGCTGGTAACAATAGGTGAATGA
ATTAGGTTCATTTGCGATGACCTTCAGTATCCCTCCACGCAATGCTAAACTATCCCCCTCATTATGACG
CCTATATCGTATAAGGAACTTGTTACCCCTGACAATTCAAACTTCAAAGGTCTAAGACCAAACAAGCGT
AGGAACTATCGCTCGGAGTGTTTCTCCGTTTGAAAAAAGAAGAGAAATAAGGGCCCTTGATTGGTGTCT
TGTCGAGAGAGGTACGTATATAAGAATGCAGTTTGCTCGCAATGCCCGCTTGTGTTAAGTACTCTTACC
TTTTCCCTCAATACTAACGTTTTGAAGCAGCCAAACTAACAATAGTATAACGTATATAGGTTAAAATAA
TATTCCAAGTCAAAAACATGTTTTCCAGATTATCCAGATCTCACTCAAAAGCATTACCGATTGCTCTAG
GTACAGTTGCTATAGCAGCTGCTACCGCATTCTATTTTGCAAACCGTAACCAACATTCCTTTGTCTTCA
ATGAATCTAATAAAGTGTTCAAAGGTGATGACAAATGGATCGACTTGCCAATATCTAAAATAGAGGAGG
AATCCCACGACACCAGAAGGTTTACTTTTAAGCTGCCTACCGAAGACTCAGAAATGGGGTTGGTCCTAG
CATCTGCTCTGTTTGCTAAATTTGTCACACCAAAGGGATCCAATGTGGTGAGACCATACACTCCTGTGA
GTGATCTTTCCCAGAAGGGTCACTTCCAGCTGGTCGTCAAGCATTATGAAGGTGGTAAAATGACCTCAC
ATTTATTTGGTCTTAAACCAAATGACACCGTTTCTTTCAAGGGTCCTATTATGAAATGGAAGTGGCAAC
CTAATCAGTTCAAGTCAATCACCTTGTTAGGTGCCGGTACCGGTATCAACCCTCTGTACCAATTAGCTC
ATCATATAGTTGAAAACCCAAACGACAAGACCAAAGTTAACTTGCTATATGGGAACAAGACTCCTCAGG
ACATTTTACTAAGGAAGGAACTGGATGCGTTGAAGGAAAAGTATCCTGACAAGTTCAATGTTACTTACT
TTGTTGACGACAAGCAAGATGACCAAGACTTTGATGGTGAAATTAGTTTCATCTCCAAAGATTTTATTC
AGGAGCATGTTCCAGGTCCAAAGGAAAGCACACATTTGTTTGTCTGCGGTCCCCCACCATTTATGAACG
CTTACTCAGGTGAGAAGAAGTCACCTAAGGACCAAGGTGAATTGATCGGTATCTTGAACAATTTGGGCT
ACTCCAAGGACCAAGTTTTCAAATTTTAA YKL150W, 302 aa (SEQ ID NO 250)
MFSRLSRSHSKALPIALGTVAIAAATAFYFANRNQHSFVFNESNKVFKGDDKWIDLPISKIEEESHDTR
RFTFKLPTEDSEMGLVLASALFAKFVTPKGSNVVRPYTPVSDLSQKGHFQLVVKHYEGGKMTSHLFGLK
PNDTVSFKGPIMKWKWQPNQFKSITLLGAGTGINPLYQLAHHIVENPNDKTKVNLLYGNKTPQDILLRK
ELDALKEKYPDKFNVTYFVDDKQDDQDFDGEISFISKDFIQEHVPGPKESTHLFVCGPPPFMNAYSGEK
KSPKDQGELIGILNNLGYSKDQVFKF YKL156W, 1099 bp, exon1: 501-503, intron1: 504-853, exon2: 854-1099
(SEQ ID NO 251)
CGAAAGGTTTCGATCAAAGTTTGGCTCAATCACTGGACACTATTACTTCGAAAGCGCAGTGGGGTTAAC
AGAGACCGTGATGTCGTCAACAAGTATTTGAAGGAAAATGGTTACTATTAAGAAAAAATCTCTTTTCTA
GCCATTTTGCCTTTTTATATAGTCAAGTATCTATATGTGACAAATACTTCTTCTAAGCTTGGCCTTCTG
ATAGGCTTAGCTTGCAGTGGTTGCAAACATACATAAATCAACAAAAAAGTACGGCTTAAAATTTTGGTA
TTCATTTATTTCAACCCGTGCACACTGGAAATAAATCTGTACATAACAGCATATTTTGTTTTTGAAAAA
ATTTCTGTGTTCCTCCGATGTGGGAAGAATTTTAGGATCGGCTAAATTTCGTAAAGTATCAGTAACTTG
GTATCTCTGTATAAGCGGAGTCTAATTTCGATAACAAGCAACTTCATCGTAACACCTTCCAACAAAGCA
AAGATAGATATCCCAAAATGGTATGTTAGTATCCAATAAATGCAGCGCAACTGGACCAGTGAATAGAAC
AATACATATAGATAAGTCGCAAAAGAAAAGAATACATGTGGTGGAAAATTTTGCACCAAGAGAGGCAAG
AACTATGAAGAAAGACTTTTGAAATATTTCAAGCGGTTGCTACATATAGTGGATAAGATTCAGGATGGA
CGTATGAGCTTACAGTTCATTGTAGGGGAATATAAAATTCTGATGATGGCGAACTTCATTCCCAGCAAC
TCAAGCTATTGTTATTTTTCTATTCTGCACCGAGATGAGGAGAAAAAAGGAAGTTTACTAACAGTTAGA
TTTATTTCTTATTCGTCTACAACAGGTTTTAGTTCAAGATTTATTGCACCCAACTGCAGCTTCTGAAGC
AAGAAAGCACAAATTAAAGACATTAGTCCAAGGTCCAAGATCGTACTTCCTAGACGTTAAGTGCCCAGG
TTGTTTGAACATCACTACAGTTTTCTCACACGCCCAAACTGCAGTTACCTGCGAATCCTGCTCAACAAT
TTTGTGCACCCCAACTGGTGGTAAGGCAAAGCTTTCTGAGGGTACATCTTTCAGAAGAAAGTAA YKL156W, 82 aa (SEQ ID NO 252)
MVLVQDLLHPTAASEARKHKLKTLVQGPRSYFLDVKCPGCLNITTVFSHAQTAVTCESCSTILCTPTGG
KAKLSEGTSFRRK YLR029C, 1115 bp, CDS: 501-1115 (SEQ ID NO 265)
TCGACACTTACTTAATATGTTTTGCCGCCCTTCATAAGAGGGTGTTTCTAAAATTTATTGGGCAAGAAT
GAGATGGACTCGCACCCTACATGACGTTTAAATATTTAGTGTTAAGGTTCAGAACATGCACCAGGTGCG
ACATGTGTTGCGATTATCATGACAATGTCTCTATCCGAGATGCATTTGTAGTATCAATTGATGCGTATT
ATGACATGATTTACATAGCATACATCGTCAAACATGATATTATATTCTTTTTTTGATAAATGTACGGAT
TTAAAGCTGTCGAATATATTTTCTGAAATTTCTTGGAGCTGACGCAAAATTTTCAAAGGTGCTAAAATT
TTTCAAGATTTCTCACTTTTGCTTGGTAACAAAGAATGATGGCATTGCATTTTTACCACCGGTACATTT
AACTGCTATTTCTCACGTTTCTTTCCCTATCCTTAAGTAATTCTTTTACAATCTAAGAAAACCACGATC
AAACAAATAAATCAGCAATGGGTGCCTACAAATATTTGGAAGAATTGCAAAGAAAGAAGCAATCTGATG
TTTTGAGATTCTTGCAAAGAGTCAGAGTCTGGGAATACAGACAAAAGAATGTCATTCACAGAGCCGCTA
GACCAACTAGACCAGACAAGGCTAGAAGATTGGGTTACAAAGCTAAGCAAGGTTTCGTTATCTACCGTG
TCAGAGTTAGACGTGGTAACAGAAAGAGACCTGTTCCAAAGGGTGCTACTTACGGTAAGCCAACTAACC
AAGGTGTCAATGAATTGAAATACCAAAGATCCTTGAGAGCTACCGCTGAAGAAAGAGTTGGTCGTCGTG
CCGCTAACTTGAGAGTCTTGAACTCCTACTGGGTTAACCAAGATTCTACTTACAAGTACTTCGAAGTTA
TCTTGGTCGACCCTCAACACAAGGCTATCAGAAGAGATGCTCGTTACAACTGGATCTGTGACCCAGTTC
ACAAGCACCGTGAAGCTAGAGGTTTGACTGCCACTGGTAAGAAATCCAGAGGTATCAACAAGGGTCACA
AATTCAACAACACCAAGGCTGGTAGAAGAAAGACCTGGAAGAGACAAAACACTTTGTCCTTGTGGAGAT
ACAGAAAATAA YLR029C, 204 aa (SEQ ID NO 266)
MGAYKYLEELQRKKQSDVLRFLQRVRVWEYRQKNVIHRAARPTRPDKARRLGYKAKQGFVIYRVRVRRG
NRKRPVPKGATYGKPTNQGVNELKYQRSLRATAEERVGRRAANLRVLNSYWVNQDSTYKYFEVILVDPQ
HKAIRRDARYNWICDPVHKHREARGLTATGKKSRGINKGHKFNNTKAGRRKTWKRQNTLSLWRYRK YLR038C, 752 bp, CDS: 501-752 (SEQ ID NO 267)
GGAAAGCAAAGCTCTAAATGATAACTCTACAAAAAAGTCAGAGAAATCTGTCACTAATTTATTGAAGGA
TGAAGAATTAATGCTTAAAGTCTTAGAGCTTTTGGTGACAAGTGCTGCAAACGCCACAGACCCAATTAA
AGCTACCGATTCGTGGGACATGTGTTTCCAATTAATACGCTTACTCAAGGAATTAGACAGAGAAAACAA
CACACAATTGGTTCAAAAAGCACTCGAGAGATTCAAATAAATCTATATGACACCATGTATTCTTTACCA
TATAGCTTCATAACATTGACCAATCAATTTTCAGAAATGCGTCGCGCGTAGTTTTGCCCGATATCCCCA
TCCCTTCAGGATCTTTAAAAGGTGATGAAAGATGCACCAGATAGAAAGTTGCATTAAAATGATTAGCA
GAGATATACAAATATTTTAGTAAGAATACATAAAGTATCTTTGCTTTCACAAATAGGAACAAGCACATA
AATACAGTATAATAGACATGGCTGATCAAGAAAACTCTCCACTACATACAGTTGGTTTCGATGCTAGAT TTCCCCAACAAAACCAAACAAAGCATTGTTGGCAATCTTATGTGGATTATCACAAGTGTGTTAATATGA
AGGGCGAAGATTTTGCTCCGTGCAAGGTCTTTTGGAAGACCTATAACGCCTTATGTCCCCTAGACTGGA
TCGAAAAATGGGATGATCAAAGAGAAAAAGGTATTTTCGCAGGTGATATCAACTCAGACTAA YLR038C, 83 aa (SEQ ID NO 268)
MADQENSPLHTVGFDARFPQQNQTKHCWQSYVDYHKCVNMKGEDFAPCKVFWKTYNALCPLDWIEKWDD
QREKGIFAGDINSD YLR312C, 1697 bp, CDS: 501-1697 (SEQ ID NO 285)
CATCAATTAGGGCAAACTTGAATAGTCAGCTAGGTCATATATTTAAAATCAATTAGCCCTATGACTACA
TTAGGTTTATTGTTAGGTCTTTACGGCTGCATATTTGCTTTCGCCGTTCGGCGGGGTCCTGCGACGATT
TCTGCGCGGTCTTGTATGGGTGGAGTTGACAGTTAACCCTCCGGACCCCCTACCCCGGTGTGCCCCCGG
TCCATCTATCCATTTTGCGGTAACCCCTTTGCGCGACAGCTGCTTATCAAGGTACCTGGATCGAGCCAT
AAAAATTGATCTACACAGATGAGATGGGGCATTGGGATATATTATTAGTCGGAGTATCATTATAGTTAT
TCAGTTTTATGCAGGTTACTGGCCAAACGTTTTTCTTCATTTGGAATAATCGTTTAGGAGCTACTGTTC
CGGTATAAAGTAACAAGCACAGTAGCAGAGTAATACGCAGTGACGATAATAGAGACTAGTAAAACAGTC
GAGTTGTCGGACCTAAAATGTCAGAAGAAGACGATCATTGGAATTTAGTTAGATTACGTAGATTACGTA
AAGGGAGAGAAGGGGAAGAACAGTCATCGAAGTCAGAAATATCTTTGGATAGTTTGCATGAAAGCTCCT
TTGCAGGAGAGGACGACGAGGACTTCGATGCAGATGTCCTATCGAACACTAGCAGTGAAGAGTCTGCAC
AGATGAATCGTATTTACGATTTTAGAACATCTAATGAATTTAGTAATGCTGGAGTTAATATTGATCAAA
CTGGAGTTCCCACTATTTCAGAGTCATTTGATACTTTGTCCGGCTCAAATGTTGGCGGAACGGTATTGC
CAAGTATGGAGGGGTCGAAACTGAAGGATAGTACGATAAGGAATTCTAGCACACTATCGGATCATATCA
TAGATAAAAGTGAGGGTAAATCTGCTAAATTGAAGATGTGGCATGTTATCATGCTATCTTCATTGCTTT
CCATGACCTTTTCATACCTCGCCCTCGAATATTCCCTGACTGGTGATGTGTTGGCAGGTTTTAAATCAC
AACAGTCATTACGTAATAATGAAAGGAAGCTGTTGTACGGCAATATCGATTTTGTTGATAAAAAATCTT
ACGATTCATCAAGTGACTCTTTAAGTCAGTGGGCTCCTTCAGGAAAATACTACGTCGACTTCGACAATC
ATATTGCATACCCATTAAAGGATGATGACCTAATGGGCTGGAGACGATACAAAACAGACTTAGTTATTT
TATGGTATACAACAAAAGCTCGAATGAAAGACGGTTGGCACAAGAGAATTAACAAAATAAACGGAGGAA
GAATAAAGTTACACCTATTTCTCAAGAATTCTTTTAAATCCGCTCAAGAAAGTTTAAGGGTATTGCATA
AAGAACAGAAACGCCGCTGGAAAAGGCTCTTTGTGCTACTTCATAATAAATACAGGCAATTTTCTCCAC
ATATTAAAAGGTATTTCGATCATTCTTGCCAAAAAGCAAAACAATGTTGGTCGGGATCCAGATTGCAGT
TGCGCAAGCTTCGTTTCAAGTCAATGAAACCATTCCGAGTTTTTCAGTTTAAGGTTCGCAAAGATACCA
ACTGGTTTGTAAAGCAGCTGAAACGGTTCGGATTGAAATTACAGCATTCGAGGATGTATAAAGCGATGT
CAGAATGCAGGAAAAAAATTATTTTAAGTGCAAACACTAG YLR312C, 398 aa (SEQ ID NO 286)
MSEEDDHWNLVRLRRLRKGREGEEQSSKSEISLDSLHESSFAGEDDEDFDADVLSNTSSEESAQMNRIY
DFRTSNEFSNAGVNIDQTGVPTISESFDTLSGSNVGGTVLPSMEGSKLKDSTIRNSSTLSDHIIDKSEG
KSAKLKMWHVIMLSSLLSMTFSYLALEYSLTGDVLAGFKSQQSLRNNERKLLYGNIDFVDKKSYDSSSD
SLSQWAPSGKYYVDFDNHIAYPLKDDDLMGWRRYKTDLVILWYTTKARMKDGWHKRINKINGGRIKLHL
FLKNSFKSAQESLRVLHKEQKRRWKRLFVLLHNKYRQFSPHIKRYFDHSCQKAKQCWSGSRLQLRKLRF
KSMKPFRVFQFKVRKDTNWFVKQLKRFGLKLQHSRMYKAMSECRKKNYFKCKH YLR414C, 1292 bp, CDS: 501-1292 (SEQ ID NO 293)
TAGTCAGCCACACATTGACGTACACTGTGAACAGCCTATTTCTTTCCATGTATCTCAGTGCCCAGCTTA
TGAGAACTGTCACAGCCTCCCACTTGACCCTCAGAGCCCTCTCCACTCCCCCCTCTTTCAACATCGCC
AGATAGCCGCCGTTGAATGGTGCGGGACAACCCGGCCTGGCCTGGCCAGGCAAAAAGGACGCAGCACG
CCTCGAGCGTTATTTCCAAATCGGGCGTACTATCAGCCAAGCCCAGCTCGGTATTTTAGCGCTTCTCG
CAGGAAAATTGGCTGAGAAGTATATATACGCGAGAATGTTGCTCTTCCATGTCTCAGTAGTCAATGAGT
GTCCAGTGGTGTTTCATTCTGGACCAGTTGTTTGGAAGTAGAACTAAAAGAAACTAGATCAAGATCATA
CAACGCTGCGCAGTAGTGAAACTTGATTAAAGCAATAGAGAACTATTAAGAAAAAAACAAACACATCAT
CGAAGGACGCTATAAGCATGAGGAATTTTTTCACGTTATTTTTTGCAGCTATATTTTCGCTAGGAGCAC
TTATATTAGCCATTGTTGCATGCGCAGGATCAACGAAAAATTACAGTCCCATAAATAAAATTTACTGTG
CAGAATTGGATCTGTCGCAGATGAAGGTATCGACGGTGCTCCCTTCTTTGAGTTCTGCTACGCTATCTT
CGTTGGGCCTGCCCTCATATATAAATATAGGGCTTTGGTCGTACTGTACAGTGGACTCCTCGCATAACA
TCCAATCATGTTCTTCGCCTCACGGTATCCAGAATTTTAACCTATCGTCATTAGTGTATGACAATATCA ACAACAATGAGGCTCTGGAGCTTATGGATTCCGTGGCCAGTGTTGTTTTGCCCGAAAAACTAAAAAGTA
AAATGACATACTACAACAATTTGGTCAAGTGTATGTTCATTACCATTCTTATTGGTATTGTCTTGACCT
TTGTGAATCTAGTGTTCAACGTATTGCGCTGGATCATCCACATAAGGCCGCTAACGTGGTTTGGTGCCT
TTTTTTCATTTTTCGCCTTTGCCGCCCTATTAGTCAGTATAGGTTCGTGTTTGGGCACTTACTCATACA
TCAAATACATCCTAAAGCATAACTATAGTGATTACGGTATTTCAATGAGCATTGGTAGGAACTACCAGG
GTTTGATGTGGGGGGCTGTCGTTGGAGCATTACTGAATTTCATTCTATGGTGTAGCGTGAGATCGAGGC
CCACCGTCATCTATGCGAACGCTCCAATTGAGGAAAAACCATTGATTTGA YLR414C, 263 aa (SEQ ID NO 294)
MRNFFTLFFAAIFSLGALILAIVACAGSTKNYSPINKIYCAELDLSQMKVSTVLPSLSSATLSSLGLPS
YINIGLWSYCTVDSSHNIQSCSSPHGIQNFNLSSLVYDNINNNEALELMDSVASVVLPEKLKSKMTYYN
NLVKCMFITILIGIVLTFVNLVFNVLRWIIHIRPLTWFGAFFSFFAFAALLVSIGSCLGTYSYIKYILK
HNYSDYGISMSIGRNYQGLMWGAVVGALLNFILWCSVRSRPTVIYANAPIEEKPLI YMR251W-A, 680 bp, CDS: 501-680 (SEQ ID NO 317)
ATCCCGTTGAAGCAACCGCACTATGACTAAATGGTGCTGGACATCTCCATGGCTGTGACTTGTGTGTAT
CTCACAGTGGTAACGGCACCGTGGCTCGGAAACGGTTCCTTCGTGACAATTCTAGAACAGGGGCTACAG
TCTCGATAATAGAATAATAAGCGCATTTTTGCTAGCGCCGCCGCGGCGCCCGTTTCCCAATAGGGAGGC
GCAGTTTATCGGCGGAGCTCTACTTCTTCCTATTTGGGTAAGCCCCTTTCTGTTTTCGGCCAGTGGTTG
CTGCAGGCTGCGCCGGAGAACATAGTGATAAGGGATGTAACTTTCGATGAGAGAATTAGCAAGCGGAAA
AAAACTATGGCTAGCTGGGAGTTGTTTTTCAATCATATAAAAGGGAGAAATTGTTGCTCACTATGTGAC
AGTTTCTGGGACGTCTTAACTTTTATTGCAGAGGACTATCAAATCATACAGATATTGTCAAAAAAAAA
AAGACTAATAATAAAAAATGAAGTTATCTCAAGTTGTTGTTTCCGCCGTCGCCTTCACTGGTTTAGTAA
GTGCTGCTAACAGTTCTAACAGCTCAAGCTCAAAGAATGCTGCCCAACCAATTGCCGGTTTAAACAACG
GTAAGGTTGCAGGCGCCGCTGGTGTTGCTCTAGCTGGTGCTTTGGCCTTTTTGATTTAA YMR251W-A, 59 aa (SEQ ID NO 318)
MKLSQVVVSAVAFTGLVSAANSSNSSSSKNAAQPIAGLNNGKVAGAAGVALAGALAFLI YNL030W, 812 bp, CDS: 501-812 (SEQ ID NO 323)
GTTTTGACACCGAGCCATAGCCGTGATTGTGCGTCACATTGGGCGATAATGAACGCTAAATGACCAACT
CCCATCCGTAGGAGCCCCTTAGGGCGTGCCAATAGTTTCACGCGCTTAATGCGAAGTGCTCGGAACGGA
CAACTGTGGTCGTTTGGCACCGGGAAAGTGGTACTAGACCGAGAGTTTCGCATTTGTATGGCAGGACGT
TCTGGGAGCTTCGCGTCTCAAGCTTTTTCGGGCGCGAAATGCAGACCAGACCAGAACAAAACAACTGAC
AAGAAGGCGTTTAATTTAATATGTTGTTCACTCGCGCCTGGGCTGTTGTTATTCGGCTAGATACATACG
TGTTTGTGCGTATGTAGTTATATCATATATAAGTATATTAGGATGAGGCGGTGAAAGAGATTTTTTTTT
TTTCGCTTAATTTATTCTTTTCTCTATCTTTTTTCCTACATCTTGTTCAAAAGAGTAGCAAAAACAACA
ATCAATACAATAAAATAATGTCCGGTAGAGGTAAAGGTGGTAAAGGTCTAGGAAAAGGTGGTGCCAAGC
GTCACAGAAAGATTCTAAGAGATAACATTCAAGGTATCACTAAGCCAGCTATCAGAAGATTAGCTAGAA
GAGGTGGTGTCAAGCGTATTTCTGGTTTGATCTACGAAGAAGTCAGAGCCGTCTTGAAATCCTTCTTGG
AATCCGTCATCAGGGACTCTGTTACTTACACTGAACACGCCAAGAGAAAGACTGTTACTTCTTTGGATG
TTGTTTATGCTTTGAAGAGACAAGGTAGAACCTTATATGGTTTCGGTGGTTAA YNL030W, 103 aa (SEQ ID NO 324)
MSGRGKGGKGLGKGGAKRHRKILRDNIQGITKPAIRRLARRGGVKRISGLIYEEVRAVLKSFLESVIRD
SVTYTEHAKRKTVTSLDVVYALKRQGRTLYGFGG YOL109W, 842 bp, CDS: 501-842 (SEQ ID NO 343)
GGAGGTCTGCTTCACGAGCGCGGTGTGCGCCTAGTATTGCCCCGACGGTCCGGGTGCCTATCCCTAGAT
TTCGTCGTGCCCCGACCCAAATAGTTAAACGTGTGGTTTATGGGTGCACCAGGGCTTTATCGTGTTTTA
TATCGATGGCGATTTGTGCCTCCAGTGTATTTTTGTATATCCAATTAAGGTTTCTTACCTAATTTTATT
TTTATCATCTTTAGTTAATGCTGGTTTGCTCTGTTTCTGCTGCTTTCTGTGCGGTTCTCCTCTTCTCTT
GTTCTTCGTGTTGTCCCCCATCGCCGATGGGCTTATATGGCGTATATATATAGAGCGAGTTTTTACGT
CGAAGATCATCTCAGTTTGCTTGATAGCCTTTCTACTTTATTACTTTCGTTTTTAACCTCATTATACTT
TAGTTTTCTTTGATCGGTTTTTTTCTCTGTATACTTAAAAGTTCAAATCAAAGAAACATACAAAACTAC
GTTTATATCAATTAATAATGTCTGAAATTCAAAACAAAGCTGAAACTGCCGCCCAAGATGTCCAACAAA AGTTGGAAGAAACCAAAGAATCTTTGCAAAACAAGGGCCAAGAAGTAAAGGAACAAGCTGAAGCTTCTA
TCGACAACCTAAAAAATGAAGCTACTCCAGAAGCTGAACAGGTGAAGAAGGAAGAACAAAACATTGCTG
ATGGTGTCGAACAAAAGAAGACCGAAGCTGCCAACAAAGTTGAAGAAACTAAGAAGCAAGCTTCCGCCG
CCGTCAGTGAGAAGAAGGAAACCAAGAAGGAAGGCGGTTTCTTGAAGAAATTGAACCGTAAAATTGCTT
CCATTTTCAACTAA YOL109W, 113 aa (SEQ ID NO 344)
MSEIQNKAETAAQDVQQKLEETKESLQNKGQEVKEQAEASIDNLKNEATPEAEQVKKEEQNIADGVEQK
KTEAANKVEETKKQASAAVSEKKETKKEGGFLKKLNRKIASIFN YOR285W, 920 bp, CDS: 501-920 (SEQ ID NO 365)
ACTAGCAAGATGATCGTCAGATATGGTGATTTATTTCCCTGTGCATTGTACTTCAAAGATCATACAGCA
TACTAAGCGCTTTCCAGGGACACCTTCTGTCGCAAAATATCAGAATTTTTCTTGATTAAACGCAGCATA
TTGAGTATATGAAATTAACGGGACACTGTGTGAAAAATTTGTAGTTGTACTTTTTTGTTATCCCCTTTG
GTAGACATATGGACGAATTACTACTAAGATTGGCTTCCATAAGGCCCAAATCCAGATATCACCTACGGT
ATGTCCTTTTCCTACTTGCAATGACAAATAATTTGTTATTTATCTTGGAACCTATATAAGTTACATCTG
ATTGCTTTTGTATTTTTTTTGGAGAATATTATTACCCGCGGGGAAGGAAGTAAGGGGAGAATTTTTGAG
GTGTATAAAAGAGAGTGGAGGCTTAATCAATCAAAGAATTCTTTCTCGTTTATTTTCAGGGTTTGTGAC
TAAGAAACGATATTAAAATGTGGAAGGCCGTGATGAATGCTTGGAATGGAACCGAGAGTCAAAGTAAGA
ATGTTTCAAATATTCAATCTTACAGTTTTGAAGACATGAAAAGAATCGTTGGAAAGCATGATCCTAATG
TGGTTTTGGTAGATGTTAGAGAACCATCTGAGTACTCGATTGTTCATATTCCTGCTTCCATCAATGTGC
CATATAGATCGCACCCTGACGCATTTGCCTTAGATCCTTTAGAATTTGAGAAACAGATTGGCATCCCAA
AACCTGACAGTGCCAAGGAGCTAATATTTTATTGTGCTTCTGGCAAACGCGGGGGAGAAGCTCAAAAAG
TCGCCTCCTCACATGGATATTCAAACACCTCACTATATCCTGGCTCTATGAATGATTGGGTTTCTCATG
GGGGTGATAAACTTGACTTATAG YOR285W, 139 aa (SEQ ID NO 366)
MWKAVMNAWNGTESQSKNVSNIQSYSFEDMKRIVGKHDPNVVLVDVREPSEYSIVHIPASINVPYRSHP
DAFALDPLEFEKQIGIPKPDSAKELIFYCASGKRGGEAQKVASSHGYSNTSLYPGSMNDWVSHGGDKLD
L YOR327C, 848 bp, CDS: 501-848 (SEQ ID NO 369)
GTGTATTATTAATACGAACAAAATAAAAATATGCCGACCAATTCTGTAGTAGTACTGTACTATATTGAA
TATTAAGGGTTTTTCTGGTCTTAGCGTATCCCTTTATCAGTCCGTGGAACAAAGCCACGGGCGGCTGTA
ACAATGACCATGGAATCATTCAGTCGCCCTAAAAGCGCATTCCACGGAGCGTTTATAGTGATCTTGGTC
ACATGATATACGCGTGACTTTTTTTTTATTTTTTCTCCCTGTCTTCCGCAAAAGTGGCTCAAAATTCTT
CGGATTTTGGCATTATAGCGCGAATGGTGCAGCGCAACCAAACAAACACCAGTTGTCGCACCCAAAAGA
TGCAAAAGCGGGGAGCCAGTTAGTTTTCCTTCAAGTTTTGGTTGAAACAGCCTTTAATATTTTATAGAA
AGGTAAACTATCTGCTCAGTGAATAGTATCTGTAAGTCAGGCATACATTCGAAACACTTCCAAATACAA
AATAAGAACGCGCAACGATGTCGTCATCAGTGCCATACGATCCATATGTGCCTCCAGAGGAGAGTAACT
CAGGCGCAAACCCAAATTCCCAAAACAAGACTGCTGCTTTGAGACAAGAGATTGATGACACGGTGGGAA
TAATGAGAGATAATATCAACAAGGTTGCTGAACGTGGTGAAAGGCTAACATCCATTGAGGACAAAGCTG
ATAACTTGGCTATCTCCGCACAAGGATTCAAGAGAGGCGCCAACAGGGTCAGAAAGCAAATGTGGTGGA
AAGATCTAAAAATGAGAATGTGTTTATTCTTAGTTGTTATTATTTTACTAGTGGTAATTATCGTTCCTA
TCGTCGTCCATTTCAGCTAA YOR327C, 115 aa (SEQ ID NO 370)
MSSSVPYDPYVPPEESNSGANPNSQNKTAALRQEIDDTVGIMRDNINKVAERGERLTSIEDKADNLAIS
AQGFKRGANRVRKQMWWKDLKMRMCLFLVVIILLVVIIVPIVVHFS YPL037C, 974 bp, CDS: 501-974 (SEQ ID NO 377)
TCACGGCTGCTCTTCCTCTTTTTCGCATATTCTATTTTATCATCGACTTCCCTAATTCGCACTCGTACC
AAAATGTTAAGCAGTATGGCGAAGAACGTGGCGCGCTGGAGTCGTGAATGTTTGGGTCCTTGATGATGG
ACTACGGTAGTAAGTATGTAGTAGTTGCAACTTCATATGTTCACTTCTGATCCAAGGAAGAGCGGTTAT
GAATTAATCTCTTGGCATGAGCGGACGGGTAAGGGGACACCGCCTTTTCTTCGATGGGAATCAGGGTAA TGGTATATGATGGATTATTGTGGAATCATTTAGTACGGCAGATGTTGAAAAAAAAAGCAGAAAATTTTT
GAATTTTTTCGTTGACATTGGAAGATTTCGTAGTGGAAACAGCTGCAATTGCTTGTTAAGTAGTAACC
CCTCCTTTGTCACAAGAGAGCGAATATTCTTTCTAGGGAGGTTTAAGAATAGAACATCTCACACCAGAC
GCGACTCATAATTCATAATGCCAATTGACCAAGAAAAATTAGCTAAGCTACAAAAGTTGTCTGCTAACA
ACAAAGTTGGTGGTACTAGAAGAAAGCTTAACAAGAAGGCAGGCTCTTCTGCCGGTGCCAACAAGGATG
ACACCAAGTTGCAAAGTCAATTAGCTAAGTTGCACGCTGTCACCATTGACAACGTCGCCGAAGCCAACT
TTTTCAAGGACGACGGTAAGGTCATGCACTTCAACAAGGTCGGTGTCCAAGTTGCTGCTCAACACAACA
CTTCTGTATTCTACGGTCTACCACAGGAAAAGAACTTGCAAGATTTGTTCCCAGGTATTATCTCTCAAT
TGGGCCCTGAAGCCATCCAAGCCTTGTCTCAATTGGCTGCCCAAATGGAAAAGCACGAAGCCAAGGCTC
CAGCTGATGCTGAAAAGAAGGATGAAGCTATTCCAGAGTTAGTTGAAGGTCAAACTTTTGATGCTGACG
TCGAATAA YPL037C, 157 aa (SEQ ID NO 378)
MPIDQEKLAKLQKLSANNKVGGTRRKLNKKAGSSAGANKDDTKLQSQLAKLHAVTIDNVAEANFFKDDG
KVMHFNKVGVQVAAQHNTSVFYGLPQEKNLQDLFPGIISQLGPEAIQALSQLAAQMEKHEAKAPADAEK
KDEAIPELVEGQTFDADVE YPL079W, 1404 bp; exon1: 501-511, intron1: 512-932, exon2: 933-1404
(SEQ ID NO 381)
AAATAGGACGAAGAACTTTTTATATACGAGCATTTCCTAATTAGTAGGAAGCGGAAAATAATAATATAA
GAAAGTAAACGCAAAAGATAGGCTGACTGCCTTCATTCGACTAGGAGGTGAGGCGACATATTTGTCACC
ATTCAAGTTACCGAGATGGTAGAGAGGTGGATGGCTCGGGTGAGCTTGATTGTACACTGCAGCAACGAT
GCTTTTTCTACCCATTTTATGAAGTTTAACATCCGTACCTTTCCACCTCCAAACATTTTTTGTAACTTC
GTCCTTTGAAAAATCAAGAAGTAATAGGTGTGCAGTATAGGGCCGCTTGAGCGCGCAATATCGGTGAGT
GAGGTAAGATCCATCCATACCTTAGCAAATATGGTAGTGAGGAGGCCAACTGTATTGCGTTAAAGGCAA
AAGGATTGGTATATACGAATGATTGGTAATTTGAAAAGTAGGTTTCGAATCAAAGAAACTGAGACAGTC
AAGGACACTAAACAAAAATGGGTAAATCGTATGTCCATATAACTTCAAAATGAAAATATAGCAGTTGAA
ACATATCAATTAAATCATTATACATCTCCAATAAACATGTATGCAAGAGGAAAGCGTAAATATCTTCGA
TTTCGACAATACTTTGCTACTGAACTAAAAATGAAAATGAAGTTGAATTCTCAAAGGAATGTGATGCAA
GTTCGTTAATTAATATGGTTTTTAGTGGAATTATCATAGTTTGTGATAGATACACACGAGGAGTAGTGA
GCAAAGCAAGTGCAACAGCAATGATATGTTAGCAGGAAATAATATTATAAATTGGATATTGTGTGTTTT
TTTGATATATGTTTGTCGAAGCTAATACAGAATGATTACTAACTGGAATTTAAAAGCACAATCATGCTC
TTGGATGATTGATCTATTAAAAAATTATAAAACAGACATGGTTACAGATCTCGTACACGTTACATGTTC
CAACGTGACTTCAGAAAGCATGGTGCCGTTCACATGTCCACCTACTTGAAGATCTACAAGGTTGGTGAC
ATTGTCGACATCAAAGCCAATGGTTCTATCCAAAAGGGTATGCCACACAAGTTCTACCAAGGTAAGACC
GGTGTCGTCTACAACGTTACCAAGTCTTCTGTTGGTGTTATCATCAACAAGATGGTCGGTAACAGATAC
TTGGAAAAGAGATTGAACTTGAGAGTTGAACACATCAAGCACTCTAAATGTAGACAAGAATTTTTGGAA
AGAGTTAAGGCCAATGCTGCTAAGCGTGCTGAAGCCAAGGCCCAAGGTGTTGCTGTCCAATTGAAGAGA
CAACCAGCTCAACCAAGAGAATCCCGTATTGTCTCTACTGAAGGTAACGTTCCTCAAACTTTAGCTCCA
GTTCCATACGAAACCTTCATTTAA YPL079W, 161 aa (SEQ ID NO 382)
MGKSHGYRSRTRYMFQRDFRKHGAVHMSTYLKIYKVGDIVDIKANGSIQKGMPHKFYQGKTGVVYNVTK
SSVGVIINKMVGNRYLEKRLNLRVEHIKHSKCRQEFLERVKANAAKRAEAKFAQGVAVQLKRQPAQPRE
SRIVSTEGNVPQTLAPVPYETFI YBL109W 836bp CDS: 501  836 (SEQ ID NO 35)
CATCGCTTGATTTCCGGCCTGCAAAATAAAGTAGTCGGTACGTACTTTCGTTTTCAATTTCCATGGTG
CACAGTATCTTAACTATCTGCTTAGTCGAGGAGAACCAGGATTCTGTTCGTTGCTCAGCCGCTTCGTGG
ATATTCTCTTGGATACTTTAAACATGGACCTACGTTCCGCTCTCGAAAAGACCAATATAATAAAAAGTT
ATAAATTACATTTCCTTATTAGGTATACGACCTCGCGCTTCGAAGTAGAGGAGCCCTTTTGGCGTACC
TACATATGGCGCGTCAGACAGACAAACTTCCCCCAAAAATGTATTACCCCGCCGAATAAGAAAACAGAC
CCATTCACCCACGACGTATCAAGTTACTTCCTTGGTGCAATGTCCCACTATAAAAAAATTCCTTGACGC
TAGATCGTTGGACTAAAATCTGCGTCACAATCGCCTAAACAGGAAATATTGCCTATTTTCGTACAAGGT
TACTTCCTAGATGCTATATGTCCCTACGGCCTTGTCTAACACCATCCAGCATGCAATACAGTGACATAT
ATATATACCCTAACACTACCCTAACCCTACCCTATTTCAACCCTTCCAACCTGTCTCTCAACTTACCCT
CACATTACCCTACCTCTCCACTTGTTACCCTGTCCCATTCAACCATACCACTCCCAACCACCATCCATC CCTCTACTTACTACCACCAATCAACCGTCCACCATAACCGTTACCCTCCAATTAGCCATATTCAACTTC
ACTACCACTTACCCTGCCATTACTCTACCATCCACCATCTGCTACTCACCATACTGTTGTTCTACCCTC
CATATTGA YBL109W 111aa (SEQ ID NO 36)
MSLRPCLTPSSMQYSDIYIYPNTTLTLPYFNPSNLSLNLPSHYPTSPLVTLSHSTIPLPTTIHPSTYYH
QSTVHHNRYPPISHIQLHYHLPCHYSTIHHLLLTILLFYPPY YHR094C 2213bp CDS: 501..2213 (SEQ ID NO 205)
GCATTGAGTCAAAAGTTTTTCCGAAGTGACCCAGTGCTCTTTTTTTTTCCGTGAAGGACTGACAAAT
ATGCGCACAAGATCCAATACGTAATGGAAATTCGGAAAACTAGGAAGAAATGCTGCAGGGCATTGCCG
TGCCGATCTTTTGTCTTTCAGATATATGAGAAAAAGAATATTCATCAAGTGCTGATAGAAGAATACCAC
TCATATGACGTGGGCAGAAGACAGCAAACGTAAACATGAGCTGCTGCGACATTTGATGGCTTTTATCCG
ACAAGCCAGGAAACTCCACCATTATCTAATGTAGCAAAATATTTCTTAACACCCGAAGTTGCGTGTCCC
CCTCACGTTTTTAATCATTTGAATTAGTATATTGAAATTATATATAAAGGCAACAATGTCCCCATAATC
AATTCCATCTGGGGTCTCATGTTCTTTCCCCACCTTAAAATCTATAAAGATATCATAATCGTCAACTAG
TTGATATACGTAAAATCATGAATTCAACTCCCGATCTAATATCTCCTCAGAAATCCAATTCATCCAACT
CATATGAATTGGAATCTGGTCGTTCAAAGGCCATGAATACTCCAGAAGGTAAAAATGAAAGTTTTCACG
ACAACTTAAGTGAAAGTCAAGTGCAACCCGCCGTTGCCCCTCCAAACACCGGAAAAGGTGTCTACGTAA
CGGTTTCTATCTGTTGTGTTATGGTTGCTTTCGGTGGTTTCATATTTGGATGGGATACTGGTACCATTT
CTGGTTTTGTTGCTCAAACTGATTTTCTAAGAAGATTTGGTATGAAGCACCACGACGGTAGTCATTACT
TGTCCAAGGTGAGAACTGGTTTAATTGTCTCTATTTTTAACATTGGTTGTGCCATTGGTGGTATCGTCT
TAGCCAAGCTAGGTGATATGTATGGTCGTAGAATCGGTTTGATTGTCGTTGTAGTAATCTACACTATCG
GTATCATTATTCAAATAGCCTCGATCAACAAGTGGTACCAATATTTCATTGGTAGAATTATCTCTGGTT
TAGGTGTCGGTGGTATCACAGTTTTATCTCCCATGCTAATATCTGAGGTCGCCCCCAGTGAAATGAGAG
GCACCTTGGTTTCATGTTACCAAGTCATGATTACTTTAGGTATTTTCTTAGGTTACTGTACCAATTTTG
GTACCAAGAATTACTCAAACTCTGTCCAATGGAGAGTTCCATTAGGTTTGTGTTTCGCCTGGGCCTTAT
TTATGATTGGTGGTATGATGTTTGTTCCTGAATCTCCACGTTATTTGGTTGAAGCTGGCAGAATCGACG
AAGCCAGGGCTTCTTTAGCTAAAGTTAACAAATGCCCACCTGACCATCCATACATTCAATATGAGTTGG
AAACTATCGAAGCCAGTGTCGAAGAAATGAGAGCCGCTGGTACTGCATCTTGGGGCGAATTATTCACTG
GTAAACCAGCCATGTTTCAACGTACTATGATGGGTATCATGATTCAATCTCTACAACAATTAACTGGTG
ATAACTATTTCTTCTACTACGGTACCATTGTTTTCCAGGCTGTCGGTTTAAGTGACTCTTTTGAAACTT
CTATTGTCTTTGGTGTCGTCAACTTCTTCTCCACTTGTTGTTCTCTGTACACCGTTGACCGTTTTGGCC
GTCGTAACTGTTTGATGTGGGGTGCTGTCGGTATGGTCTGCTGTTATGTTGTCTATGCCTCTGTTGGTG
TTACCAGATTATGGCCAAACGGTCAAGATCAACCATCTTCAAAGGGTGCTGGTAACTGTATGATTGTTT
TCGCATGTTTCTACATTTTCTGTTTCGCTACTACCTGGGCCCCAATTGCTTACGTTGTTATTTCAGAAT
GTTTCCCATTAAGAGTCAAATCCAAGTGTATGTCTATTGCCAGTGCTGCTAACTGGATCTGGGGTTTCT
TGATTAGTTTCTTCACCCCATTTATTACTGGTGCCATCAACTTCTACTACGGTTACGTTTTCATGGGCT
GTATGGTTTTCGCTTACTTTTACGTCTTTTTCTTCGTTCCAGAAACTAAAGGTTTATCATTAGAAGAAG
TTAATGATATGTACGCCGAAGGTGTTCTACCATGGAAATCAGCTTCCTGGGTTCCAGTATCCAAGAGAG
GCGCTGACTACAACGCTGATGACCTAATGCATGATGACCAACCATTTTACAAGAGTTTGTTTAGCAGGA
AATAA YHR094C 570aa (SEQ ID NO 206)
MNSTPDLISPQKSNSSNSYELESGRSKAMNTPEGKNESFHDNLSESQVQPAVAPPNTGKGVYVTVSICC
VMVAFGGFIFGWDTGTISGFVAQTDFLRRFGMKHHDGSHYLSKVRTGLIVSIFNIGCAIGGIVLAKLGD
MYGRRIGLIVVVVIYTIGIIIQIASINKWYQYFIGRIISGLGVGGITVLSPMLISEVAPSEMRGTLVSC
YQVMITLGIFLGYCTNFGTKNYSNSVQWRVPLGLCFAWALFMIGGMMFVPESPRYLVEAGRIDEARASL
AKVNKCPPDHPYIQYELETIEASVEEMRAAGTASWGELFTGKPAMFQRTMMGIMIQSLQQLTGDNYFFY
YGTIVFQAVGLSDSFETSIVFGVVNFFSTCCSLYTVDRFGRRNCLMWGAVGMVCCYVVYASVGVTRLWP
NGQDQPSSKGAGNCMIVFACFYIFCFATTWAPIAYVVISECFPLRVKSKCMSIASAANWIWGFLISFFT
PFITGAINFYYGYVFMGCMVFAYFYVFFFVPETKGLSLEEVNDMYAEGVLPWKSASWVPVSKRGADYNA
DDLMHDDQPFYKSLFSRK YBL099W 2138bp CDS: 501..2138 public: 1..2138 (SEQ ID NO 693)
CCCGGGTGATGCAGTTGCGGCCGGCCCTGGCCAATCAGATCCCTTTAAAAATGGGCCCGGTGCGCTTCT
ACCCCTTCACGCCTTTTACGCCTTTTTCGAATCTTGTATTTATTGTAATTATTAAACATTGGTCATATC
AAATTCACATCAGACTTCAATTTTTCAATTCACTTTCTGAATAAGAGCCCTTCCCTTCATACAAGTAGA
GATATTATACTGTCATAGCTCTTTCAATTGGTCTTATTAGATTGTCTCCATCTTTCCCATTGACGTTGT
TACTCCCTCTCTTTTTTCGTTTTTAACTGATTTCTCATATATTCCCAAACAGGCATATATACTCGACGT
CAAGAAAGAAAAGAAAAGAAAACCCTCATAAAAAATATAATCGAGAAGTTTTTTTCCTCATCGCGAACC ATTAGTATAACAGATTGATCGTTCAGCTCTCATAACTATCGCAAGAACAGTAACAAAATAAATAAAAAA
AACACGCACATATAATAATGTTGGCTCGTACTGCTGCTATTCGTTCTCTATCGAGAACTCTAATTAACT
CTACCAAGGCCGCAAGACCTGCCGCTGCTGCTTTGGCTTCCACCAGAAGATTGGCTTCCACCAAGGCAC
AACCCACAGAAGTTTCCTCCATCTTAGAGGAAAGAATTAAGGGTGTGTCCGACGAGGCCAATTTGAACG
AAACTGGTAGAGTTCTTGCAGTCGGTGATGGTATTGCTCGTGTTTTTGGTTTGAACAACATTCAGGCTG
AAGAATTGGTCGAGTTCTCCTCTGGTGTTAAAGGTATGGCTTTGAACTTGGAGCCTGGTCAAGTCGGTA
TCGTTCTTTTCGGTTCCGATAGACTGGTTAAAGAAGGTGAATTGGTCAAGAGAACCGGTAATATTGTTG
ATGTCCCAGTCGGTCCAGGCCTTTTGGGTAGAGTTGTCGACGCTTTAGGTAACCCTATTGATGGTAAAG
GTCCTATTGACGCTGCCGGTCGTTCAAGAGCTCAAGTCAAAGCACCAGGTATTTTGCCAAGAAGATCTG
TCCATGAACCAGTTCAAACCGGTTTGAAAGCCGTTGACGCCTTGGTCCCTATCGGTAGAGGTCAAAGAG
AGTTGATTATTGGTGATCGTCAAACAGGTAAGACTGCTGTCGCCTTAGACACCATCTTGAATCAAAAGA
GATGGAATAACGGTAGTGACGAATCCAAGAAACTTTACTGTGTTTACGTTGCCGTTGGACAAAAAAGAT
CTACCGTTGCTCAATTGGTCCAAACTTTGGAACAACATGACGCCATGAAGTACTCTATTATTGTTGCAG
CTACTGCATCTGAAGCCGCTCCTCTACAATACTTGGCTCCATTTACTGCCGCATCCATTGGTGAATGGT
TCAGAGATAATGGAAAGCACGCTTTGATCGTCTATGACGATTTGTCCAAGCAAGCCGTGGCATACCGTC
AATTATCTTTGTTGTTGAGACGTCCTCCTGGTCGTGAAGCCTACCCTGGTGATGTCTTTTACTTGCATC
CAAGATTGCTAGAAAGAGCCGCTAAGCTTTCTGAAAAGGAAGGTTCTGGTTCTTTAACTGCTTTGCCTG
TTATTGAAACCCAAGGTGGTGATGTCTCCGCTTATATTCCAACCAATGTTATTTCCATTACCGATGGTC
AAATATTCTTGGAAGCTGAATTATTCTACAAGGGTATCAGACCTGCCATTAACGTTGGTTTGTCCGTTT
CTCGTGTCGGTTCCGCTGCTCAAGTTAAGGCTTTGAAGCAAGTCGCTGGTTCCTTGAAATTGTTTTTGG
CTCAATACAGAGAAGTCGCTGCTTTTGCTCAATTCGGTTCCGATTTAGATGCCTCCACCAAGCAAACTT
TGGTTAGAGGTGAAAGATTGACTCAATTGTTGAAGCAAAACCAATATTCTCCTTTGGCTACAGAAGAAC
AGGTTCCATTGATTTATGCCGGTGTTAATGGTCATTTGGATGGTATTGAACTATCAAGAATTGGTGAAT
TTGAGTCCTCCTTTTTGTCCTATCTAAAATCCAATCACAATGAGCTTTTGACCGAAATTAGAGAAAAGG
GTGAATTGTCTAAAGAATTGTTGGCATCTCTAAAGAGTGCTACTGAATCATTTGTTGCCACTTTTTAA YBL099W 545aa public: 1..545 (SEQ ID NO 694)
MLARTAAIRSLSRTLINSTKAARPAAAALASTRRLASTKAQPTEVSSILEERIKGVSDEANLNETGRVL
AVGDGIARVFGLNNIQAEELVEFSSGVKGMALNLEPGQVGIVLFGSDRLVKEGELVKRTGNIVDVPVGP
GLLGRVVDALGNPIDGKGPIDAAGRSRAQVKAPGILPRRSVHEPVQTGLKAVDALVPIGRGQRELIIGD
RQTGKTAVALDTILNQKRWNNGSDESKKLYCVYVAVGQKRSTVAQLVQTLEQHDAMKYSIIVAATASEA
APLQYLAPFTAASIGEWFRDNGKHALIVYDDLSKQAVAYRQLSLLLRRPPGREAYPGDVFYLHPRLLER
AAKLSEKEGSGSLTALPVIETQGGDVSAYIPTNVISITDGQIFLEAELFYKGIRPAINVGLSVSRVGSA
AQVKALKQVAGSLKLFLAQYREVAAFAQFGSDLDASTKQTLVRGERLTQLLKQNQYSPLATEEQVPLIY
AGVNGHLDGIELSRIGEFESSFLSYLKSNHNELLTEIREKGELSKELLASLKSATESFVATF YDR504C 884bp CDS: 501..884 public: 1..884 (SEQ ID NO 695)
TAAAAGCCTTGCATATTGCTCAGAGTAAATTACAAGCGTTAAATGATAATTCAAAATCTCAAAATACAA
ATGACAGTTCTTCCAATAATTTTACGAATGCTGCAACTTATTCAAAGCCTAAATTGAATATCAAGATTT
TAAACGCAGAATTCCAATTTGATAGAAAGGAATTAACGTTTTACTACGTTTGTGAGGAGAGAAATGATT
TTAGAGACTTGATAAAAGAGCTGTTCAAATATTACAAGACAAGAATTTGGTTGTGTGCCATCCCGAATA
ATCTGTCTATTGATTCTAAGTATTATGATAAACAACAAAAGAGCTGAAATTATATCAAAACATAGTAA
AAAATTACAATGCTGAAGATTTAATGAATGTCAATGAGTTTTCGCAGAACAGGGGGAATAACAGAGTTA
ATTTTGCACCTCCGTTGAACGAAATTGAACTCGACAACTTTCAGATTGCTGTGTATGAAGAATTAGTTC
ACGAATTATTTCATTAAATGATCTGTTATTTCCTTGTTGTAACTATAAATTTTCTAAAAGAAAAGACAA
CCATTTGCCATTATTTTGTTAACATTTTTTCATTGTTTTTGTTTTGTTTGTTTTTGTTTTGTTTTTA
TTTTTGTCTACTTTTTTTATGTTATTTTGTTTATCGTTTCTGTTCGTTGTTTACCTATTTTCCTGCCA
ATTCAATTTGGTACTATCTTTCTATTATCAATATTTCTTTCCCTTATGTTTTTTCTATATGAAAACT
TCACAGGGAGAAATAGAAGAAAATGTTCATTATTCTGTTTAACTTTGATAAAAATTACTTATACGTCTC
CCAATCATGGTTTCATGGTCACTGGTAAGGAAAAATTCGAAAAACTACGGGACTAA YDR504C 127aa public: 1..127 (SEQ ID NO 696)
MICYFLVVTINFLKEKTTICHYFVNIFSLFLFLFVFVFVFIFVYFFYVILFYRFCSLFTYFPANSIWYY
LSIINIFFPLCFFLYENFTGRNRRKCSLFCLTLIKITYTSPNHGFMVTGKEKFEKLRD YEL032W 3416bp CDS: 501..3416 public: 1..3416 (SEQ ID NO 697)
TATCTACCGGCTGCAAGCAGCCGGTCGGTGGCAAATCCGGCGCTTCCCCCTCAAAAAAAAAAAAAAAAA
AAAAAAAAGGGAACTCTCAGAACGGGGGAGGTTGAAGAGCAGGCCAAGGGAAATATTAGTTTTGACCTA
TGTGGGAAACAGAATTTTCAATGAGTTATGGCAACTTGGCCGAGTGGTTAAGGCGAAAGATTAGAAATC
TTTTGGGCTTTGCCCGCGCAGGTTCGAGTCCTGCAGTTGTCGTTATTTTTCTCTTTTTTTTCAATTTCC
CTTGTTCGTCAGATCGAGGCGGTAGAAGAAACAATTACTTTTCCTAAATGGGTAAAAACTCGTGTTTTA
GGAAAAAAAGAAAAATTTGGTCAAAACTCGAAAGATAGGTTCTTAATCTTCTTTCAAGTTGAAAAGGC
CTACGCTCTTTTCCTTGAAGCATTTTCATCCTACTGCTCGTATTGAACTCCACTATAAGCGCACCAAAA
AGATACAAACGTCAATTATGGAAGGCTCAACGGGATTTGATGGAGACGCTACTACTTTTTTCGCTCCAG
ACGCTGTGTTTGGTGACAGAGTGCGCAGATTTCAAGAGTTTTTAGATACTTTCACCTCATACAGAGACT
CTGTAAGGTCCATACAAGTTTACAACAGCAATAACGCGGCCAACTACAACGATGATCAAGATGACGCAG
ACGAACGAGATTTGCTAGGTGATGACGACGGTGATGATCTTGAAAAGGAAAAGAAAGCAGCATCGTCCA
CCTCATTGAATATACTCCCTCACAGGATTATCATCTCGCTTGATGACTTGAGAGAATTCGACAGGTCGT
TCTGGTCGGGCATTTTAGTCGAACCAGCATACTTCATCCCGCCTGCCGAAAAGGCGCTTACTGACCTAG
CAGATTCCATGGACGATGTTCCACATCCCAATGCCTCTGCAGTATCGTCTCGCCATCCTTGGAAGCTTT
CGTTCAAAGGCTCATTTGGTGCACACGCATTGTCTCCTCGTACTCTAACGGCACAACATTTAAACAAAC
TGGTCTCTGTTGAGGGTATCGTAACTAAGACTTCGTTGGTCAGGCCAAAGCTTATCAGATCTGTCCACT
ACGCGGCAAAGACTGGTAGATTCCATTACAGAGATTATACAGATGCTACTACAACTCTCACCACCCGCA
TCCCAACGCCTGCCATCTATCCAACGGAGGACACTGAAGGTAACAAACTAACCACCGAATATGGGTATA
GTACGTTCATAGACCATCAGCGTATCACTGTGCAAGAAATGCCCGAAATGGCCCCCGCTGGCCAACTTC
CCAGGTCCATTGACGTCATTCTCGATGACGACCTTGTGGACAAGACCAAGCCAGGTGACAGAGTTAACG
TTGTCGGGGTATTCAAGTCGCTTGGTGCTGGTGGCATGAACCAGTCCAACTCTAATACATTGATCGGGT
TCAAAACTCTGATCCTAGGTAATACGGTGTATCCTCTCCACGCCAGATCCACGGGTGTCGCTGCGAGAC
AAATGTTGACAGATTTCGATATAAGAAATATCAATAAACTATCCAAAAAAAGGACATTTTCGATATCT
TGTCTCAATCTTTAGCGCCTTCTATTTATGGACATGACCATATAAAGAAAGCCATTTTATTGATGCTCA
TGGGAGGTGTGGAGAAAAATTTAGAAAATGGCTCGCATTTAAGAGGTGACATCAATATCCTAATGGTGG
GTGATCCATCCACTGCCAAGTCCCAATTGCTAAGGTTTGTGTTGAATACAGCATCACTGGCAATTGCTA
CTACTGGTAGAGGTTCTTCCGGTGTCGGTTTGACCGCAGCGGTCACTACTGATAGGGAAACAGGTGAAA
GAAGACTAGAGGCTGGTGCCATGGTTCTTGCTGACCGCGGGGTTGTATGTATTGATGAATTTGATAAGA
TGACAGATGTGGATAGAGTCGCCATTCATGAAGTAATGGAACAACAAACGGTGACGATTGCCAAAGCAG
GTATTCACACAACATTAAATGCTCGTTGTAGTGTTATTGCTGCCGCAAATCCCGTTTTTGGGCAGTACG
ATGTCAATAGAGATCCACACCAAAACATTGCCCTACCGGACTCGCTGTTGTCTCGTTTTGATTTACTAT
TTGTTGTGACAGACGATATCAATGAAATCAGAGATAGATCCATTAGTGAGCATGTCTTAAGAACACACA
GATATTTGCCTCCAGGTTATTTAGAGGGTGAACCTGTGAGAGAGCGTTTGAATTTATCATTAGCCGTTG
GGGAGGATGCAGATATAAATCCTGAAGAGCATTCCAACTCCGGGGCTGGTGTAGAAAATGAAGGAGAAG
ATGATGAAGACCATGTCTTCGAAAAGTTCAACCCCTTATTACAAGCAGGTGCTAAGTTAGCAAAAAACA
AAGGTAACTATAACGGTACAGAAATTCCAAAGCTAGTCACCATCCCATTCTTAAGAAAGTACGTTCAAT
ATGCCAAGGAAAGGGTTATTCCACAGTTAACACAAGAAGCCATCAATGTTATTGTGAAAAATTATACTG
ATTTAAGAAACGATGATAATACCAAAAAATCGCCCATTACTGCAAGAACTTTGGAGACTTTGATCAGAT
TAGCCACAGCTCACGCCAAAGTCAGGTTATCCAAAACAGTCAACAAGGTGGATGCTAAAGTGGCTGCCA
ATCTACTAAGGTTTGCACTATTGGGTGAGGATATCGGCAATGATATCGATGAAGAGGAAAGTGAATACG
AAGAAGCTTTGTCGAAGAGGTCTCCACAGAAATCACCGAAAAAAAGACAAAGAGTCAGACAACCAGCAA
GCAACTCTGGATCCCCAATCAAATCTACTCCAAGAAGGTCAACGGCATCTTCCGTTAATGCCACGCCAT
CGTCAGCACGCAGAATATTACGTTTTCAAGATGACGAACAGAACGCTGGTGAAGACGATAACGATATAA
TGTCACCGCTTCCTGCGGATGAGGAAGCTGAATTACAAAGAAGGCTTCAACTGGGGTTGAGAGTGTCTC
CAAGACGTAGAGAACATCTTCACGCACCTGAGGAAGGTTCGTCGGGACCTCTTACCGAGGTCGGTACTC
CAAGATTACCTAACGTATCTTCTGCAGGTCAGGATGATGAGCAACAACAGTCAGTTATTTCTTTTGACA
ATGTGGAGCCTGGTACCATTTCTACTGGTAGATTGTCTTTAATCTCAGGTATTATTGCGCGTCTGATGC
AAACAGAAATATTTGAAGAAGAATCCTATCCTGTGGCCTCTTTGTTCGAAAGAATCAACGAAGAACTAC
CGGAGGAGGAAAAATTCTCCGCTCAAGAATATTTAGCAGGTTTGAAGATCATGTCGGACAGAAATAACT
TAATGGTTGCTGACGATAAAGTTTGGAGAGTCTGA YEL032W 971aa public: 1..971 (SEQ ID NO 698)
MEGSTGFDGDATTFFAPDAVFGDRVRRFQEFLDTFTSYRDSVRSIQVYNSNNAANYNDDQDDADERDLL
GDDDGDDLEKEKKAASSTSLNILPHRIIISLDDLREFDRSFWSGILVEPAYFIPPAEKALTDLADSMDD
VPHPNASAVSSRHPWKLSFKGSFGAHALSPRTLTAQHLNKLVSVEGIVTKTSLVRPKLIRSVHYAAKTG RFHYRDYTDATTTLTTRIPTPAIYPTEDTEGNKLTTEYGYSTFIDHQRITVQEMPEMAPAGQLPRSIDV
ILDDDLVDKTKPGDRVNVVGVFKSLGAGGMNQSNSNTLIGFKTLILGNTVYPLHARSTGVAARQMLTDF
DIRNINKLSKKKDIFDILSQSLAPSIYGHDHIKKAILLMLMGGVEKNLENGSHLRGDINILMVGDPSTA
KSQLLRFVLNTASLAIATTGRGSSGVGLTAAVTTDRETGERRLEAGAMVLADRGVVCIDEFDKMTDVDR
VAIHEVMEQQTVTIAKAGIHTTLNARCSVIAAANPVFGQYDVNRDPHQNIALPDSLLSRFDLLFVVTDD
INEIRDRSISEHVLRTHRYLPPGYLEGEPVRERLNLSLAVGEDADINPEEHSNSGAGVENEGEDDEDHV
FEKFNPLLQAGAKLAKNKGNYNGTEIPKLVTIPFLRKYVQYAKERVIPQLTQEAINVIVKNYTDLRNDD
NTKKSPITARTLETLIRLATAHAKVRLSKTVNKVDAKVAANLLRFALLGEDIGNDIDEEESEYEEALSK
RSPQKSPKKRQRVRQPASNSGSPIKSTPRRSTASSVNATPSSARRILRFQDDEQNAGEDDNDIMSPLPA
DEEAELQRRLQLGLRVSPRRREHLHAPEEGSSGPLTEVGTPRLPNVSSAGQDDEQQQSVISFDNVEPGT
ISTGRLSLISGIIARLMQTEIFEEESYPVASLFERINEELPEEEKFSAQEYLAGLKIMSDRNNLMVADD
KVWRV YGR146C 1136bp CDS: 501..1136 public: 1..1136 (SEQ ID NO 699)
CTTTCAGTTGGGCATCTTTTTTTTTCACAATTAGGCCGCCCTTTTTTCCCAAATTGGCACTTGTTTGTA
CGATCTTTAGCTAGAACTTGGAGACCTGAAACGTGGTGATTCTTATATTTAAAGGAATACCGATCTTTT
CCGTTTCAACACCCCAATTGTGAGAATTTTATTTCTTGCATTTCGGAAAATTTAGATACATTCACATCC
ATACTTGGACACATATATATATACAATATAATCATTGACACAGGCCATCGCCATTGAGTAAACTGTCTT
TGAACTGTCTAAAGAACTTAGAACTATAGTGTTGTCCCAAGAAGTTAAAAATTGAACACTTGTGAGAAT
TATAAAACAGAGTAAGCAAAGAAAGAATAGAGAAACAATACTCCGCTACCGATTCTCCTTTTTTTCCTT
ATAAAAAAAGCTCGAGAATAATTACTTTATTCTTATCCCTCCACTCCTTTCAGGTATTCTTTACCGATT
TGCATATCAATCATATAATGAGCACCGCATTCAACGATTACTGCACTGTTTGTGATCGTCTCATTCCAA
CATCTCCACAGAAAACGAACATTAATACCAGGAAGATCCAAAGGGACAATGAAACCAAGAGCAGTTTAC
AATCAAATAAGTTATATTGCTCCGAAGATTGTAAGCTGAAGGATTCGAACCCTCTTAATGAGAAATTAT
TATCCCACTTGCATAAAAAATCAAAAACTTCTCATTCGCATAATCTCACTCCACCGCTTTCATATTCTA
AAAATTTAACTGCATCAAACCTCTTCGAGCCGACTACCTCACTATCTTCATCTCCGACATCTTCAACTA
TCCCCTTTGACGAGTTGGAGAAGCTAGAGTCCTTATTAATTTCACCATTGCTGCTACCTCAGGATGGTA
TAGTCAATCCTAAGCAGGAGTCTAATCCTTCTCGTGTTGACGAATATGATGAAAATGAACATTATTTGA
ACTTAGCCGACTCTCTTAGACTCGATTCTAGTTACCAATTGCATTCAAAGGCACATTTGGGTTACGAAA
ACAACTTGCCACGATCAAACGATCTAATTGATGATCATTTGATCTCAGATCAGATCATTGAGAATAACT
ACAACCTATGGTTTAGACTATCCTCCAGTTAA YGR146C 211aa public: 1..211 (SEQ ID NO 700)
MSTAFNDYCTVCDRLIPTSPQKTNINTRKIQRDNETKSSLQSNKLYCSEDCKLKDSNPLNEKLLSHLHK
KSKTSHSHNLTPPLSYSKNLTASNLFEPTTSLSSSPTSSTIPFDELEKLESLLISPLLLPQDGIVNPKQ
ESNPSRVDEYDENEHYLNLADSLRLDSSYQLHSKAHLGYENNLPRSNDLIDDHLISDQIIENNYNLWFR
LSSS YHR135C 2117bp CDS: 501..2117 public: 1..2117 (SEQ ID NO 701)
AGAGTATAACGAGTACATTAATGAGAAAGATTCAAGTAGAGCGCAGCGTCAAAACGCTGCCGCCGTTTT
AAGCAAGCTCGCCCATGACTTTTGGGAGAACGACTGTGTCATTGACGAAGACATATTCGAAGATTCGTC
TGACGAAGAACAATCATGATTGCATCTCTTAATCGTTACACATACATACCTTCTACCTCTGTACTGTTA
CATATGCATTGACTTTACGATCTAATATAAATCCTTTTGATGTTACCCCGCCTGTGGGCTCGTTCTCCT
TTCGTTTCTTACGATTTTTTCGCCGGAACAAGAAAAAACAGAACAAAACAAATCAGCGATCGTATACAT
GGGTCTTTGATTTCTGCTTGCTTCTTACAAACAACAAACGCAAACCGTTCATTGAGTGCTCTGTGACTG
GTTTTCATGTGGATGCCATAGTAGAGAAAAGACACATACAAAAATTTCGCGCATTCGCTGGCCCTTTTC
CTGCTCTCCTCTTCCCCATGTCCATGCCCATAGCAAGTACCACTCTAGCAGTTAACAACCTCACCAATA
TAAACGGAAACGCAAATTTTAACGTACAAGCAAACAAACAACTCCACCACCAGGCTGTCGACTCGCCCG
CAAGATCTTCGATGACCGCCACGACCGCCGCCAACTCCAACAGCAACTCTTCCAGAGATGACTCTACTA
TTGTCGGCCTACATTACAAGATCGGCAAAAAATAGGGGAAGGTTCCTTTGGTGTGCTATTTGAAGGTA
CTAATATGATCAATGGCGTACCCGTCGCGATCAAATTCGAGCCCAGAAAAACGGAGGCCCCTCAATTAA
GAGATGAATATAAAACATATAAAATTCTGAATGGCACTCCCAATATCCCCTACGCGTACTACTTCGGCC
AAGAAGGTTTGCACAATATCTTGGTCATTGATCTTTGGGTCCCTCTTTGGAAGATTTATTTGATTGGT
GTGGAAGAAAATTTTCTGTCAAAACGGTTGTGCAAGTTGCTGTCCAAATGATTACTTTGATTGAAGACT
TGCACGCACATGACTTGATATACCGTGATATCAAACCAGACAATTTCTTGATTGGAAGGCCCGGCCAAC
CTGACGCAAACAACATCCATTTGATCGACTTCGGTATGGCCAAACAGTATCGTGATCCGAAAACTAAAC AGCACATCCCATATAGAGAGAAAAAATCACTCAGCGGCACTGCCAGATATATGTCCATTAATACTCACC
TTGGAAGAGAGCAGTCCAGAAGAGATGATATGGAGGCCTTGGGTCACGTTTTCTTTTATTTCTTGAGAG
GCCACTTACCCTGGCAGGGTTTAAAAGCTCCAAACAATAAGCAAAAATACGAAAAGATTGGTGAAAAGA
AAAGATCTACTAACGTTTACGATCTAGCTCAAGGCTTACCTGTGCAATTTGGCAGGTATCTAGAAATCG
TCAGAAGTCTTTCCTTTGAAGAGTGTCCCGATTATGAAGGCTATAGAAACTATTACTATCTGTACTGG
ATGATTTAGGTGAAACCGCGGACGGCCAATATGATTGGATGAAACTGAACGATGGCCGTGGTTGGGATC
TTAACATAAACAAGAAGCCAAATCTCCACGGATACGGCCATCCAAATCCACCAAACGAAAAATCGAGAA
AACATAGAAACAAACAGCTCCAAATGCAACAGCTCCAAATGCAACAGCTCCAACAACAGCAACAGCAAC
AGCAATATGCTCAAAAAACTGAGGCAGATATGCGCAATTCTCAATATAAACCAAAGTTAGACCCTACTT
CTTATGAAGCTTACCAGCATCAAACCCAGCAGAAATACCTGCAAGAACAACAAAAGAGACAGCAGCAAC
AAAAACTTCAGGAGCAACAACTTCAAGAGCAACAATTGCAACAGCAGCAACAGCAACAGCAACAGCTAC
GTGCAACAGGCCAACCTCCATCTCAGCCTCAAGCGCAAACTCAATCTCAGCAGTTTGGCGCTCGTTATC
AACCACAACAACAACCTTCTGCTGCTTTAAGAACTCCTGAACAGCACCCAAATGACGATAATTCAAGTC
TAGCTGCTTCTCATAAGGGCTTTTTCCAAAAATTAGGTTGTTGCTAA YHR135C 538aa pulic: 1..538 (SEQ ID NO 702)
MSMPIASTTLAVNNLTNINGNANFNVQANKQLHHQAVDSPARSSMTATTAANSNSNSSRDDSTIVGLHY
KIGKKIGEGSFGVLFEGTNMINGVPVAIKFEPRKTEAPQLRDEYKTYKILNGTPNIPYAYYFGQEGLHN
ILVIDLLGPSLEDLFDWCGRKFSVKTVVQVAVQMITLIEDLHAHDLIYRDIKPDNFLIGRPGQPDANNI
HLIDFGMAKQYRDPKTKQHIPYREKKSLSGTARYMSINTHLGREQSRRDDMEALGHVFFYFLRGHLPWQ
GLKAPNNKQKYEKIGEKKRSTNVYDLAQGLPVQFGRYLEIVRSLSFEECPDYEGYRKLLLSVLDDLGET
ADGQYDWMKLNDGRGWDLNINKKPNLHGYGHPNPPNEKSRKHRNKQLQMQQLQMQQLQQQQQQQQYAQK
TEADMRNSQYKPKLDPTSYEAYQHQTQQKYLQEQQKRQQQQKLQEQQLQEQQLQQQQQQQQLRATGQP
PSQPQAQTQSQQFGARYQPQQQPSAALRTPEQHPNDDNSSLAASHKGFFQKLGCC YJL060W 1835bp CDS: 501..1835 public: 1..1835 (SEQ ID NO 703)
TAGAGCAGATTGTTTTGAGTAGGATTTAGGAATCAAGACCTCCATCTTTGTCGCATTATTCCTAAATGT
AACGTAACTCGTTTGATAAGAGAATGTCTAATCGAAGAGAGTTAATAACTTAATAAGCTCTTTAAAAGA
ACGATGGCATTTATCGTCTCCTATGCCAAGATAATTACTGGCTCAAAATTGTTCAGCGTTCATAAAACT
TTGATATCACTTTCTGGCGCACAAGCTAACCTTTATGTAGTTCTTACGTAGATTCTTTTTAGCAAGTGC
CTGGTAGTGGTTATTACATAAATGTATCTTTTCATTTGATAACAATTTCTTCAGTAGCATGTCGTGTCT
AGCACGTGACGTAGAACTGTGGCTTTTTTGTTGTCATTATGACAATCAAGATACCAAAATTCAGTCATG
TTTAAAAGGGGAAGGTACGATAGAGATATATATAAAGTGTTCAATTTACTATAATTGCGTATAGAATCC
ATTGTTACTTGCTCTCAATGAAACAACGATTCATTCGTCAATTTACGAACCTAATGTCTACTTCGAGAC
CGAAAGTTGTTGCCAACAAATATTTCACTTCTAACACTGTCCAAAGATGTTTGGTCGCTAACCAATGAAG
CCGCTGCAAAAGCTGCCAATAACTCCAAAAACCAAGGCCGTGAACTTATTAATTTAGGCCAAGGCTTTT
TTTCATATTCCCCTCCTCAATTCGCCATTAAGGAGGCTCAGAAAGCCCTAGACATTCCAATGGTCAATC
AATATTCTCCAACTAGAGGTCGACCTTCATTAATTAATTCCTTGATTAAGTTGTATTCTCCTATTTATA
ACACAGAATTGAAAGCGGAAAATGTTACCGTAACAACAGGTGCCAATGAAGGTATACTTTCTTGCTTGA
TGGGGCTTTTGAACGCTGGCGACGAGGTTATTGTTTTGAACCTTTCTTTGACCAATATATTCCAAATA
TCGAACTTTGCGGTGGTAAAGTTGTTTACGTCCCCATAAATCCTCCAAAGGAATTGGATCAAAGGAATA
CTAGAGGTGAAGAATGGACCATTGACTTTGAGCAGTTCGAAAAAGCGATTACATCCAAGACAAAAGCTG
TCATTATCAATACCCCTCACAACCCAATTGGTAAAGTTTTCACGCGCGAGGAATTAACCACTTTAGGTA
ACATTTGCGTCAAGCACAACGTTGTGATTATATCTGATGAAGTCTATGAACACCTTTACTTCACTGATT
CTTTCACTAGAATTGCCACACTCTCTCCAGAAATTGGGCAACTAACCTTAACGGTCGGTTCTGCCGGTA
AATCGTTTGCTGCTACTGGTTGGAGAATTGGTTGGGTCTTATCCTTGAACGCAGAGTTGTTAAGTTATG
CAGCTAAGGCACATACAAGAATTTGTTTTGCATCTCCATCCCCTCTACAGGAAGCTTGTGCAAACTCTA
TTAACGACGCTTTAAAAATTGGGTATTTTGAAAAAATGAGACAGGAATATATCAACAAATTCAAAATTT
TCACATCGATCTTTGATGAATTGGGACTACCATATACAGCTCCAGAGGGTACATATTTTGTCCTCGTTG
ATTTCTCTAAAGTGAAAATTCCCGAGGACTATCCCTACCCAGAGGAGATCCTGAATAAGGGAAAAGATT
TTCGCATTTCTCACTGGTTGATCAATGAATTAGGTGTGGTTGCCATTCCACCAACTGAATTCTATATCA
AAGAGCACGAAAAGGCTGCTGAGAATTTGTTAAGGTTTGCAGTTTGTAAAGATGATGCTTATCTAGAAA
ATGCCGTAGAGAGATTAAAACTACTCAAGGACTACTTATAA YJL060W 444aa public: 1..444 (SEQ ID NO 704)
MKQRFIRQFTNLMSTSRPKVVANKYFTSNTAKDVWSLTNEAAAKAANNSKNQGRELINLGQGFFSYSPP
QFAIKEAQKALDIPMVNQYSPTRGRPSLINSLIKLYSPIYNTELKAENVTVTTGANEGILSCLMGLLNA
GDEVIVFEPFFDQYIPNIELCGGKVVYVPINPPKELDQRNTRGEEWTIDFEQFEKAITSKTKAVIINTP
HNPIGKVFTREELTTLGNICVKHNVVIISDEVYEHLYFTDSFTRIATLSPEIGQLTLTVGSAGKSFAAT
GWRIGWVLSLNAELLSYAAKAHTRICFASPSPLQEACANSINDALKIGYFEKMRQEYINKFKIFTSIFD
ELGLPYTAPEGTYFVLVDFSKVKIPEDYPYPEEILNKGKDFRISHWLINELGVVAIPPTEFYIKEHEKA
AENLLRFAVCKDDAYLENAVERLKLLKDYL YKL123W 881bp CDS: 501-881 public: 1..881 (SEQ ID NO 705)
AAAATTAATGGATGTAACACAAAATATTGGCATTGATCTTTTCATTGGAATTGGCGCGTTTAATGCCGC
ATATACAAGAACATATACGAGGGATGGTCTATTGGAAGACCCGGATAATGTTAGCTTCCGTGAAGCTCT
CTCTGAAGGCAAAGATATTGAAGTCGCCAAAGATCTTCAAAGAGTTCACGATCCACATGATGAAAGTGA
TGAAATGACGTCAGATGAGGTTGAATTACATGTTAATTTGGGCCAAGTTGGGTTCGTCTTTATAGAAGC
CAATGTGAAAAAATATGCGTTTGGGAGTGTTTATGCCCAAATTGGAATTCCTCCTGCGTATAATGGAAC
CGAGATCAAGAAGGATACTATTTTACAGAAAGGAGAAGAATTGCCACCAAGATATGCTGACACTGATAA
TTTCTTTGGTAGTATGAAGGTAAAAGAAGGGTCATCCTCTAGGATAACGGCGCAAACTAGTAAGCCCCT
GTGGTCTGTTGGGACGTATGAAAGAATCTCTTCTAACTTTGACAGAGAAAATAATGTTTACCACGACAG
TCTTGAAACCGACGATAACAACACCGATAACAATGTTAATAACAACGATGAGAACGCTGGTTGCAATGA
AAAATTCGCCATTATTGGAAGATGATGGCAATAAAAGACCGGAAAATTCAAATACCCCCGTGAAGTATC
AGATGGAGCTATCAATAAGAACCCTAGAAATAAATCTACTAAAAAACGTCAAAGAAACAGAGGCAAATC
TTCTAAAAAGAAGAACAGATCGAGAAAATAAGAGACATTATGAATTTGGTTTTTTTTACAATTTACGCA
TACACAATATATACATTCCTACTAGCTTTTTTTTCTTCAATTCGATAGTTTAG YKL123W 126aa public: 1..126 (SEQ ID NO 706)
MKESLLTLTEKIMFTTTVLKPTITTPITMLITTMRTLVAMKIRHYWKMMAIKDRKIQIPPVKYQMELSI
RTLEINLLKNVKETEANLLKRRTDRENKRHYEFGFFYNLRIHNIYIPTSFFFFNSIV YML028W 1091bp CDS: 501..1091 public: 1..1091 (SEQ ID NO 707)
GGTAAACGATAGGGTGATAACCGCTGTGATAAAGAACTTCGTGCTCTTTTGGGTTACACTACTCCCTA
TGTGAAGGAGAAGCTGGATGATATTGTTGCACAGAGAGCAAGGGACCGTGAGCAACCGGCTCCATCTGC
CCAACAGCAGGAAAACGAAGATGAGGCCCTCATAATCCCTGACGAGGAAGAACCCACCGCCACAGGTGC
GCAACCTCATCTCTACATTCCTGATGAAGACTAATTGCAATGCGATGTGGCCACGTTATATAATGCGTT
TAAGGTGTACGAAAACCCATGCTGTTCTGGCCCGTCGGGTTTTCTGACAAATTGTCCTTTAGGGATTTT
TCGGTTTGGCTCGGGTTGGCAAAGTCGGCTGGCAACAAACCAGGACATATATAAAGGGAGGTAATTCGT
CAGATCAATGCCGAACCGTTCTCAACGGGCCTTCCCCTCGTTCAATTGCTCACAACCAACCACAACTAC
ATACACATACATACACAATGGTCGCTCAAGTTCAAAAGCAAGCTCCAACTTTTAAGAAAACTGCCGTCG
TCGACGGTGTCTTTGACGAAGTCTCCTTGGACAAATACAAGGGTAAGTACGTTGTCCTAGCCTTTATTC
CATTGGCCTTCACTTTCGTCTGTCCAACCGAAATCATTGCTTTCTCAGAAGCTGCTAAGAAATTCGAAG
AACAAGGCGCTCAAGTTCTTTTCGCCTCCACTGACTCCGAATACTCCCTTTTGGCATGGACCAATATCC
CAAGAAAGGAAGGTGGTTTGGGCCCAATCAACATTCCATTGTTGGCTGACACCAACCACTCTTTGTCCA
GAGACTATGGTGTCTTGATCGAAGAAGAAGGTGTCGCCTTGAGAGGTTTGTTCATCATCGACCCAAAGG
GTGTCATTAGACACATCACCATTAACGATTTGCCAGTCGGTAGAAACGTTGACGAAGCCTTGAGATTGG
TTGAAGCCTTCCAATGGACCGACAAGAACGGTACTGTCTTGCCATGTAACTGGACTCCAGGTGCTGCTA
CCATCAAGCCAACCGTTGAAGACTCCAAGGAATACTTCGAAGCTGCCAACAAATAA YML028W 196aa public: 1..196 (SEQ ID NO 708)
MVAQVQKQAPTFKKTAVVDGVFDEVSLDKYKGKYVVLAFIPLAFTFVCPTEIIAFSEAAKKFEEQGAQV
LFASTDSEYSLLAWTNIPRKEGGLGPINIPLLADTNHSLSRDYGVLIEEEGVALRGLFIIDPKGVIRHI
TINDLPVGRNVDEALRLVEAFQWTDKNGTVLPCNWTPGAATIKPTVEDSKEYFEAANK YOL052C-A 686bp CDS: 501..686 public: 1..686 (SEQ ID NO 709)
TGGCCACTGAAAATTCCTGGCCAGACCACCCCTGAGCTAAGGGAGTTTAGCCGCTCAAGCTTTTATTTC
CTCTGATGTAATATATCACACACCCAGACACGGTTGCCAAGGCCTCGACGGAAGGCCGCTTCAAGGGAC
GGGGCAGTGGCTATCAGAAATACCTTAATATCATCAATATTTTTCATCAATCGCAAGGTGTCAAACATC
AATAAAGGATGATGCTCAAAGGTTTATGCCCGATGTTCTTCTAATCCCCTTTCTCTCCTAAAATAATCC TTTTTTTACTCTTCTTCTTTTCCCCTGTTTCCATTTTTGTCTTTTCTCACCCCTTATGGGACATCAATA
ATGCAAGTATGTTTATACATTTTTATATAAATGTATATATAAATGCCATTTCTTACACATAACCTCCAT
TCTTTGGTTAATTCTTTCTTCATTCTTTTTTTTTCATTCTGAAAAGCCCTCCAAGCAAGCACGCTAAT
TTAATATCGATTTAAACATGAAAGTATCACAAGTTTTCATTTCTGCCATCTCTGTCTTCGGCCTCGCTA
CTAGCGTAAATGCTCAAAACGCATCCAACACCACGAGTAACGCTGCTCCTGCTTTGCACGCTCAAAATG
GTCAACTACTAAACGCCGGAGTCGTCGGTGCTGCTGTTGGTGGTGCTTTGGCCTTTTTGATTTAG YOL052C-A 61aa public: 1..61 (SEQ ID NO 710)
MKVSQVFISAISVFGLATSVNAQNASNTTSNAAPALHAQNGQLLNAGVVGAAVGGALAFLI YOL099C 992bp CDS: 501..992 public: 1..992 (SEQ ID NO 711)
TGTCCAAATATGTTGATGAATTCTGTTTGCAAAGGGGGAACAACTTCAATGAATTGTATTTGGAAAGGT
TGCAGAATGTTACCAAAACAGATCTGAAAAATGCCATGCAGAAATATTTTGTCAACATGTTTGATTCCA
ATAAAAGCGTTGCCTTTGTGAGCTGTCATCCAGCTAAATTGGAATCAGTTCAAGAATTCTTTGAAACTC
AAGGTTTCACTGTCGAAATAGAAGAGCTAGAAGATGACGATGACGAAATTGATAGTGAAGAAGACGAAA
ATGCGTGAGTACATGACCTCCATTTCAGCTTCACTTTCAACACAGAAACAGTGCGTATTATCTGCATTC
AATAAATAGCAAAAGGAGCATTGTCTCATTCTTTTCGAATTCTGGGATTCTGCCTTACGGCGCTCTTTC
ATTTGATTGATCGAGAATTATTATTATATTTATATGAGTACTTGAAATTCCTCATATATTTATTTTTAG
AGTATTTAAGTAGCTTGATGAAAACATTAGATAAAATTACTAATTACGACCTCTTCGATTTTGCAGATG
AGTTTTTGAAATTTGTTCCTGTGTTTAGACCTAATCCCACGGTAACTTGTCTTTTTGGCAATCCGTTAA
CTAATTTACTGGTTAACGGTACTGGAGCAGCGTGTTTTTTGAATTTTGTTCCTTGGCATTGATAAAGG
TTTCAAAAATTCTGCTTGATCTGTTGCTCTTAGCGCTATTAATCGATTCAGAAACGAATTGTGCTTTG
AAATTGATGGAGATTGGCTATGCGTCCTGGGTTTTGGCGAAGGAGACTTGGAAGTTGGAAGATCTTTAG
GTATGGCTCTTCCGGATGATGATGTTCTTCTTTCAATTACCTTTTGGTTTCTTTGCAACAGTTCTTTCT
CTATTTTATTTGTATTCGAATTAAGAATTTTTTTGAGAACAGTAAACAATTTGCTCGTGGTTTTTTTAT
CAGTGCTCAAAAGAAATGACTTGTAA YOL099C 163aa public: 1..163 (SEQ ID NO 712)
MKTLDKITNYDLFDFADEFLKFVPVFRPNPTVTCLFGNPLTNLLVNGTGAACFFEFCSLALIKVSKILL
DLLLLALLIDSENELCFEIDGDWLCVLGFGEGDLEVGRSLGMALPDDDVLLSITFWFLCNSSFSILFVF
ELRIFLRTVNNLLVVFLSVLKRNDL YOL100W 3746bp CDS: 501..3746 public: 1..3746 (SEQ ID NO 713)
TTAACGATCGACTCGACACATTGTTGATGGAATAATTGGTCCCTAGTTAAACAGCGGAGAAATAGCCGC
CCAGGATAATCGGAGAAAAGTCACGTGCAAAAAGAAATCATATTCGACGAAATAAACTAGAATAACTTT
TGACGTTTAGCAATAATAACCCCAAATGGAAGCGAACATTTCCCGATCCTTTTAGTTTTCTTTAAGGCG
CTATTGGCATTCATCTTCAAAGCTTCCGCAACACAGAAATTATATATTCACATTTCTGAGGCAGAGAAT
AGTTTTGACAACGAAACTGTTAATATTTTTACTCCAGTTACCGCCTTTGAAGTCTGATATTGGTGTACA
AAGGTACTTAGGGGTATTTAAGAACAAGAAACTACATAAAATAGTTCGAAAAGGGAAAACAAAAGTAAC
ATCTTGATGAACCGAGAAGCCACTAACTAGTTTTTAAAAAGCAAAAGAAATTAAATCTCTCCTTTTTTT
TTTTTCATTTCAACCAAATGTATTTTGATAAGGATAATTCCATGAGCCCTAGGCCGTTATTGCCAAGTG
ATGAGCAGAAGCTAAACATTAATCTTCTAACGAAAAGGAGAAATTCTCGCATTTAGACCCCCATTATG
ACGCAAAAGCCACTCCACAAAGAAGCACTTCGAATAGAAACGTTGGCGATTTACTTTTGGAAAAAAGAA
CCGCTAAGCCTATGATTCAAAAGGCCTTGACGAATACGGATAATTTCATTGAAATGTACCATAATCAGC
AGAGAAAAAATCTTGATGATGACACTATTAAAGAAGTAATGATTAATGATGAAAACGGAAAAACTGTCG
CTAGTACCAACGACGGCAGATATGACAACGATTACGATAATAACGATATTAATGACCAAAAAACTTTGG
ATAATATAGCGGGAAGTCCCCACATGGAAAAAAATCGAAACAAAGTAAAGATTGAACATGACTCTTCAT
CTCAAAAACCAATAGCTAAAGAGTCATCCAAAGCCCAAAAAAATATAATCAAAAAGGGAATCAAGGACT
TTAAATTTGGTAGTGTAATAGGTGATGGCGCGTATTCTACTGTAATGTTAGCGACGTCGATTGATACCA
AAAAGAGGTACGCCGCAAAAGTACTAAACAAAGAATATTTAATACGCCAGAAGAAAGTCAAATACGTCA
GCATAGAAAAAACCGCCCTTCAAAAGCTCAATAATTCTCCTAGTGTTGTGCGATTATTTTCCACTTTTC
AGGATGAATCAAGCCTATACTTTCTCTTAGAGTATGCCCCCAATGGGGACTTTCTTTCTTTAATGAAAA
AATACGGTTCATTAGACGAAACCTGCGCACGATATTATGCTGCGCAAATAATAGATGCCATAGACTACT
TACATTCCAACGGTATTATTCATAGAGATATAAAACCAGAAATATTCTTTTAGATGGAGAAATGAAGA
TCAAACTGACTGATTTTGGTACTGCGAAGTTACTGAATCCTACAAATAATAGCGTTTCGAAACCAGAAT
ACGATTTATCAACAAGGTCGAAATCTTTCGTTGGAACTGCAGAATACGTATCTCCAGAACTTTTAAATG

```
ACAGTTTTACAGACTATCGTTGCGATATTTGGGCCTTCGGATGTATACTTTTCCAGATGATTGCCGGAA
AACCACCATTCAAAGCTACCAATGAATACTTGACTTTCCAAAAGGTAATGAAAGTTCAGTACGCCTTTA
CACCAGGTTTCCCACTTATTATCAGAGATTTGGTTAAGAAAATCTTAGTAAAAAACTTAGACCGAAGAT
TGACGATAAGCCAAATTAAGGAACATCATTTTTTCAAAGATTTGAATTTTAAAGACGGCTCTGTTTGGT
CAAAAACGCCTCCAGAGATCAAACCATATAAAATCAACGCCAAATCCATGCAGGCAATGCCAAGCGGAA
GCGATAGAAAACTGGTGAAGAAATCAGTCAACACACTTGGCAAATCGCATCTAGTGACTCAAAGGTCAG
CTTCAAGTCCCTCTGTTGAGGAAACTACTCATTCAACCCTATACAATAACAATACTCACGCTTCTACTG
AAAGTGAAATATCAATAAAGAAGAGACCCACTGATGAAAGAACAGCGCAGATACTTGAAAATGCAAGAA
AGGGTATAAACAATAGGAAAAATCAACCAGGCAAGAGAACACCAAGTGGTGCAGCTTCTGCTGCCCTAG
CAGCTTCTGCTGCTTTAACCAAGAAAACCATGCAAAGCTATCCAACTTCTAGTTCGAAAAGTAGCAGGT
CAAGCTCTCCTGCGACAACATCAAGACCAGGAACTTATAAGCGTACTTCTTCTACAGAAAGTAAACCAT
TTGCCAAATCTCCACCTTTGTCAGCATCAGTTTTATCGTCAAAAGTCCCAATGCCTCCATACACACCTC
CAATGTCGCCCCCTATGACACCATATGATACATATCAAATGACACCTCCCTATACGACAAAACAGCAGG
ATTATTCTGATACCGCAATTGCCGCACCTAAGCCTTGTATTAGTAAGCAAAATGTTAAAAATAGCACAG
ATTCTCCCTTGATGAACAAGCAAGATATTCAATGGTCCTTTTACCTGAAAAACATCAACGAACATGTAC
TAAGGACGGAAAAACTGGATTTTGTTACCACAAATTACGATATCTTAGAGAAGAAAATGCTTAAACTAA
ATGGTTCATTGTTAGATCCTCAACTGTTTGGTAAGCCTAGACATACTTTTTTATCCCAAGTAGCTAGGA
GTGGGGGAGAGGTTACAGGTTTTCGAAATGATCCAACTATGACTGCTTATTCCAAAACAGAAGATACGT
ACTATTCGAAAAATATTATCGATTTGCAGCTCTTGGAAGATGATTATCGAATTGAAGGAGGTGACTTAT
CGGAGTTGCTTACTAACAGAAGCGGAGAAGGGTACAAATGCAATCAAAACAGCTCACCAATGAAAGACG
ATGATAAATCCGAATCTAACAATAAAGGAAGCTCTGTTTTTCTGGCAAGATTAAAAAATTATTTCACC
CTACCTCAGCAGCTGAAACGCTCTCTTCCTCTGATGAAAAAACCAAGTACTATAAACGAACCATTGTAA
TGACATCATTTGGAAGGTTTCTAGTATTTGCCAAGAGGAGGCAGCCAAATCCAGTTACAAATTTAAAGT
ATGAACTAGAATATGACATAAATTTGCGTCAACAGGGTACCAAAATAAAAGAACTAATCATTCCCTTGG
AAATGGGAACTAATCATATAGTTGTGATTCAGACACCTTACAAGTCATTTCTTTTGAGCACTGATAAAA
AAACCACGAGCAAATTGTTTACTGTTCTAAAAAAATTCTTAATTCGAATACAAATAAAATAGAGAAAG
AACTGTTGCAAAGAAACCAAAAGGTAATTGAAAGAAGAACATCATCATCCGGAAGAGCCATACCTAAAG
ATCTTCCAACTTCCAAGTCTCCTTCGCCAAAACCCAGGACGCATAGCCAATCTCCATCAATTTCAAAGC
ACAATTCGTTTTCTGAATCGATTAATAGCGCTAAGAGCAACAGATCAAGCAGAATTTTTGAAACCTTTA
TCAATGCCAAGGAACAAAATTCAAAAAAACACGCTGCTCCAGTACCGTTAACCAGTAAATTAGTTAACG
GATTGCCAAAAAGACAAGTTACCGTGGGATTAGGTCTAAACACAGGAACAAATTTCAAAAACTCATCTG
CAAAATCGAAGAGGTCGTAA

YOL100W 1081aa public: 1..1081 (SEQ ID NO 714)
MYFDKDNSMSPRPLLPSDEQKLNINLLTKKEKFSHLDPHYDAKATPQRSTSNRNVGDLLLEKRTAKPMI
QKALTNTDNFIEMYHNQQRKNLDDDTIKEVMINDENGKTVASTNDGRYDNDYDNNDINDQKTLDNIAGS
PHMEKNRNKVKIEHDSSSQKPIAKESSKAQKNIIKKGIKDFKFGSVIGDGAYSTVMLATSIDTKKRYAA
KVLNKEYLIRQKKVKYVSIEKTALQKLNNSPSVVRLFSTFQDESSLYFLLEYAPNGDFLSLMKKYGSLD
ETCARYYAAQIIDAIDYLHSNGIIHRDIKPENILLDGEMKIKLTDFGTAKLLNPTNNSVSKPEYDLSTR
SKSFVGTAEYVSPELLNDSFTDYRCDIWAFGCILFQMIAGKPPFKATNEYLTFQKVMKVQYAFTPGFPL
IIRDLVKKILVKNLDRRLTISQIKEHHFFKDLNFKDGSVWSKTPPEIKPYKINAKSMQAMPSGSDRKLV
KKSVNTLGKSHLVTQRSASSPSVEETTHSTLYNNNTHASTESEISIKKRPTDERTAQILENARKGINNR
KNQPGKRTPSGAASAALAASAALTKKTMQSYPTSSSKSSRSSSPATTSRPGTYKRTSSTESKPFAKSPP
LSASVLSSKVPMPPYTPPMSPPMTPYDTYQMTPPYTTKQQDYSDTAIAAPKPCISKQNVKNSTDSPLMN
KQDIQWSFYLKNINEHVLRTEKLDFVTTNYDILEKKMLKLNGSLLDPQLFGKPRHTFLSQVARSGGEVT
GFRNDPTMTAYSKTEDTYYSKNIIDLQLLEDDYRIEGGDLSELLTNRSGEGYKCNQNSSPMKDDDKSES
NNKGSSVFSGKIKKLFHPTSAAETLSSSDEKTKYYKRTIVMTSFGRFLVFAKRRQPNPVTNLKYELEYD
INLRQQGTKIKELIIPLEMGTNHIVVIQTPYKSFLLSTDKKTTSKLFTVLKKILNSNTNKIEKELLQRN
QKVIERRTSSSGRAIPKDLPTSKSPSPKPRTHSQSPSISKHNSFSESINSAKSNRSSRIFETFINAKEQ
NSKKHAAPVPLTSKLVNGLPKRQVTVGLGLNTGTNFKNSSAKSKRS YOR302W 578bp CDS:501..578 public:1..578 (SEQ ID NO 715)
GTGTATGATGTAATCCATCACCCCCCTATAAAAACACCTGTGCACCGCATATTTCCATAGCGCGTGACG
CTAAGTACAAGAAACAGCGAGGGGCCGTTAAGTGCAGGCTTTACCGAGGGCGCCGGCTGGCGCTTCCCG
TGGAAGGGTGTTTGACTCATCATCGCATCGCATTACCTCATGATGAGTAAATAGTTGCGATTTCACTTA
TCACCTCTCGCGGAAAAAAAAGGCGATGACATGATATATAAGGCTCTCTCGTAAGACACTTAACTATCC
```

```
AACGTTCATTAGATTATTCGGTCAATTTCTTTTTTCATGCCCCTCCTTTTTCTTTTCTTTTCTTGACTC
GTCGTTTCTTTTTCTTTTTTTTTTTTTTTTTTTCTTCAGAACTATAACACATAGATACACTCGAACAT
CTAATTGTTTAAATACTGCAAAGAATACAAGGTAATCGACTCTTCTACATACCCTTTTTGCAGATTTGA
AATAAAAAAAACATTATATGTTTAGCTTATCGAACTCTCAATACACCTGCCAAGACTACATATCTGACC
ACATCTGGAAAACTAGCTCCCACTAA

YOR302W 25aa public: 1..25 (SEQ ID NO 716)
MFSLSNSQYTCQDYISDHIWKTSSH
```

Figure 2

Candida spp. homologues

YBL002W_homolog 393bp public: 1..393 (SEQ ID NO 397)
ATGGCCCCAAAAGCAGAAAAGAAACCAGCTTCCAAAGCTCCAGCTGAAAAGAAACCAGCTGCTAAGAAA
ACCGCTTCCACCGATGGTGCTAAAAAGAGAACCAAAGCTAGAAAAGAAACTTATTCCTCATATATATAT
AAAGTTTTGAAACAAACACATCCAGACACTGGTATCTCCCAAAAGGCCATGTCAATTATGAATTCGTTT
GTTAACGATATTTTCGAAAGAATTGCCACCGAAGCCTCCAAATTAGCTGCTTACAATAAAAAATCCACA
ATTTCCGCTAGAGAAATCCAAACTGCTGTTAGATTAATTTTGCCAGGTGAATTGGCCAAACATGCCGTT
TCCGAAGGTACCAGAGCCGTCACAAAATACTCATCTGCTTCTAGTTAG YBL002W_homolog 130aa (SEQ ID NO 398)
MAPKAEKKPASKAPAEKKPAAKKTASTDGAKKRTKARKETYSSYIYKVLKQTHPDTGISQKAMSIMNSF
VNDIFERIATEASKLAAYNKKSTISAREIQTAVRLILPGELAKHAVSEGTRAVTKYSSASS YBL064C_homolog 732bp public: 1..732 (SEQ ID NO 399)
ATGAGAGACAAAAAACAAACAAAAAAAAAAAATCTTTTTTTTTCGCCACGCACACTACCATGTCGCAA
CAACCACATTTACGTCTCGGATCTACCGCACCTGATTTCAAAGCTGATACAACTAACGGGCCTATTCTG
TTTCACGAATACATTGGTGATAGCTGGGCTATCTTGTTCTCACATCCCGCTGCCCACACCAGTGTGTGT
AGCACCGAGCTTTCTGCGTTCGCACGACTCGAACCGGAGTTCACGAAGAGAGGGGTGAAATTGCTTGCA
ATTTCAGCCGACCCTGTTGAAGCAAATTCCGACTGGATTGTATATGGAAGATTTTAGCGGATCCAGG
GTCAAATTTCCAATTATCGCAGACCCTGAGAGAAAAGTTGCTACCTTGTACGACATGATCGATCACCAA
GATGCCACCAATCTCGATGACAAAGGGCTTCAATTGACAATTCGTGCAGTGTTTATCATTGATCCAAGT
AAGAAAATCAGATTGATCATGACCTACCCTGCCTCGACCGGTAGAAACACCGCTGAAGTATTGAGAGTA
CTCGACTCATTACAGCTTGTTGATAAACAAAAGGTTATCACTCCAATCAATTGGGTTCCAGGTGACGAT
GTTCTTGTCCATATGGGTGTCCCAGATGATGAGGCAAGAGTTTTGTTTCCTAAATATAGGGCTATAAAG
CCATATATTAGATTGACTCCGTTGGAAAAGGAAGACAAGTAA YBL064C_homolog 243aa (SEQ ID NO 400)
MRDKKQTKKKKSFFFATHTTMSQQPHLRLGSTAPDFKADTTNGPISFHEYIGDSWAILFSHPAAHTSVC
STELSAFARLEPEFTKRGVKLLAISADPVEANSDWIDDMEDFSGSRVKFPIIADPERKVATLYDMIDHQ
DATNLDDKGLQLTIRAVFIIDPSKKIRLIMTYPASTGRNTAEVLRVLDSLQLVDKQKVITPINWVPGDD
VLVHMGVPDDEARVLFPKYRAIKPYIRLTPLEKEDK YBR149W_homolog 981bp public: 1..981 (SEQ ID NO 401)
ATGAAATTAGCCACTGAAATTGATTTCAAACTCAACAATGGTAAAACCATTCCTGCCTTAGGACTAGGT
ACTGTTGCCTCAAAAGATCCTAAAGATGTTAAGGATCAAGTAATCACTGCTGTTAAAGCAGGATATCGT
CATATTGATACTGCTTGGTTTTATGGTACTGAAAAATATATTGGTGAAGCATTACAAGAATTATTTGCT
GAAGGAATTATTAAAAGAGAAGATTTATTTATCACGACAAAATTTTGGCCATCATATTGGGCTAATCCA
GAAAAATCTTTAGATGAATCTTTAAAAGATTTGCAACTTGATTATGTTGATTTATTTTTACAACATTGG
CCAATTTGTTTACATGGTGATGAAAATGGATTACCGAAAATACCTAAGGATGAGAATGGTGAATTGATT
TATGATGATGATCCAACCCCAAATGGTACTAAATATATCGACGTTTATCATAATTAGAGGATATTTTA
GAAACAACCACCAAAGTTAGATCAATTGGTGTTTCTAATTATTCAATTCCAAAACTTCGTCAATTATTA
CCTAAAGTTAAAAAACATATTCCTGTTTGTAATCAAATTGAATATCATCCACAATTACCTCAACAAGAT
TTAGTTGATTATTGTACTAAAAATAATATATTGATTTCTTGTTATTCACCAGTTGGTAGTTATGGAGCT
CCAGTATTGAAAATCCCATTAGTTAAGCAATTGGCAGAAAAATATCAAGTCACAGAGAATGAAATTGCT
GATGCTTATAATATTTTGAATGGTAGAGTTACATTACCAAGATCTTCTAATCTTGAAAGAATTAAAACC
ATTATTAGATTACCACATTTGACTAAAGAAGAATTGGATGAATTGTATCAAGTTGGAGTTAAAGATCCA
CAAAGATATATTTGTGATCCTTGGGGGTATGGTATAGGATTCCGTTGGTGGAAAGGCGATACTTTAAGT
AAAGAATTTGATTAA YBR149W_homolog 326aa (SEQ ID NO 402)
MKLATEIDFKLNNGKTIPALGLGTVASKDPKDVKDQVITAVKAGYRHIDTAWFYGTEKYIGEALQELFA
EGIIKREDLFITTKFWPSYWANPEKSLDESLKDLQLDYVDLFLQHWPICLHGDENGLPKIPKDENGELI
YDDDPTPNGTKYIDVYHKLEDILETTTKVRSIGVSNYSIPKLRQLLPKVKKHIPVCNQIEYHPQLPQQD
LVDYCTKNNILISCYSPVGSYGAPVLKIPLVKQLAEKYQVTENEIADAYNILNGRVTLPRSSNLERIKT
IIRLPHLTKEELDELYQVGVKDPQRYICDPWGYGIGFRWWKGDTLSKEFD YBR289W_homolog 1389bp public: 1..1389 (SEQ ID NO 403)
ATGAAACCAATGCAAAACGTTAAGGAGTGGTCAGAAAAATTGAAACAGGAAGGTAAAGATGTACCTCTT
GATTTGAAAGTGTATGAAGATTTGATTAGAAAGGATAAGGAATTTGTGGGTAAATTGAATAAACAGTTG
CATGACAACAAATTTATTATGGAAAATATTAACAGAGATATCAAGTCTTATAATCAAATCAAACAATTG AGGATGAATTCTATTGCGTTGTCCAACAAAGGACAGTATAATAACAGTATTTGGGGGGAAGGATATCAA
GGTTATGGCAATGGAATAACAAACTCCAGTACAAAGTTATTTATTCCCAACAGGGATTTAACTGATAGA
ATCATCAATGAAAGAGTGATGAAAAACAAAAATAAACCAAAACATTATGTACCCATTCGATTAGAGTTT
GACCAAGAAAGGGATCAATTTAAATTGAGAGACACATTTCTTTGGGATTTGAATGAAGACGATTATAAAA
GTGGAAGATTTCACTGCTCAATTGTTAGAGGATTATAAATTTATCTCCAAAGTTCATTATGAAACAATT
TTGTCATCTATTAAAGAGCAGATTGCTGACTATCTGCAGAAACCTAGCAAAACAATGGGTGAATTGAGA
ATTCCAATTAAGATCGATATCACCATTAACAATACACAATTAACTGACCAATTTGAATGGGATATATTG
AATAGCCAGGAAGGCGATGCAGAAGAATTTCATCTTACATGTGCGACGAATTGTGTCTACCGGGAGAG
TTTTGCACTGCCATCGCGCATAGCATAAGAGAACAATCGCAGATGTACTATAAAGCATTGAATATGGTA
GGGTACGGTTTCGACGGTTCACCAGTACACGAAGATGAGATTAGAAATCATTTATTGCCACCTTTAAGA
TTAGTATCATCGGACTCTGGAATCGTGGATGATTTTTTCTCAATTTTAAGAAACCCATCAAGTTTGCCA
GACTTTTCACCTACGTTAGGTAAATTGTCCCAATTGGAAGTTGAAAGATTGGACAAGGAAATGGAGACA
GAAAGTAGAAGGAAAAGAAGACACAATTACAATGAAGATCAGCAACAGGGTTCTGGTCGAGGCTTCACT
TCGAGAAGAATTGCAGCTCATGCTGGTAGGGGAAACACCATTCCCGACTTGTCAGACATACCCAAGACA
TTTAGGACGCCTGCCCCCTCATCCATATTGCCAGGTGCTGTTGATATGGGTGTACCTGAGGTGTATGAA
TATAATGAAGTTTTAATCAATAGAACTCAAGTTAGGAATCCAGATTATAGACCGCCAACACCTATTCGT
GTTGAAAATGAACTAGTGGATTATAACCATGATCCAATTGAAGGTACTTTTATGGTTACAATCAAATTA
CCCGTATAA YBR289W_homolog 462aa (SEQ ID NO 404)
MKPMQNVKEWSEKLKQEGKDVPLDLKVYEDLIRKDKEFVGKLNKQLHDNKFIMENINRDIKSYNQIKQL
RMNSIALSNKGQYNNSIWGEGYQGYGNGITNSSTKLFIPNRDLTDRIINERVMKNKNKPKHYVPIRLEF
DQERDQFKLRDTFLWDLNEEIIKVEDFTAQLLEDYKFISKVHYETILSSIKEQIADYSQKPSKTMGELR
IPIKIDITINNTQLTDQFEWDILNSQEGDAEEFSSYMCDELCLPGEFCTAIAHSIREQSQMYYKALNMV
GYGFDGSPVHEDEIRNHLLPPLRLVSSDSGIVDDFFSILRNPSSLPDFSPTLGKLSQLEVERLDKEMER
ESRRKRRHNYNEDQQQGSGRGFTSRRIAAHAGRGNTIPDLSDIPKTFRTPAPSSILPGAVDMGVPEVYE
YNEVLINRTQVRNPDYRPPTPIRVENELVDYNHDPIEGTFMVTIKLPV YCR004C_homolog 597bp public: 1..597 (SEQ ID NO 405)
ATGGCACAAGGAAAAGTAGCAATTATCATTTATTCATTATATCATCATGTTTATGATTTAGCCTTAGCT
GAAAAAGCTGGAATTGAAGCTGCTGGAGGTGTTGCTGATATTTATCAAGTTGCCGAAACATTATCTGAT
GATGTTTTAGCTAAAATGCATGCACCAGCAAAACCAGATATTCCAATTGCAACTCATGAAACTTTAACT
CAATATGATGCATTTTTATTTGGTATTCCAACCAGATTTGGTAATTTCCCTGCTCAAATTAAAGCTTTT
TGGGATAGAACCGGTGGTTTATGGGCTAAAAATGCTTTAAGGAGGGAAATATGCTGGTGTTTTCGTTTCT
ACTGGTACTCCAGGTGGTGGTCAAGAAACTACCATTATTAATAGTTTGAGTACTTTGGCTCATCATGGG
ATTATTTATGTTCCATTTGGGTATGGATATCCTGGTATGACTGATTTAGAAGAAGTTCATGGTGGATCT
CCTTGGGGGGCTGGTACTTTTGCTTCAGGTAATGGGTCAAGAAAAGTTACTGATTTAGAAAAAGCTATT
GCTAAACAACAAGGTGAAGATTTCTTTAAAACTGTCTTCAAATGA YCR004C_homolog 198aa (SEQ ID NO 406)
MAQGKVAIIIYSLYHHVYDLALAEKAGIEAAGGVADIYQVAETLSDDVLAKMHAPAKPDIPIATHETLT
QYDAFLFGIPTRFGNFPAQIKAFWDRTGGLWAKNALRGKYAGVFVSTGTPGGGQETTIINSLSTLAHHG
IIYVPFGYGYPGMTDLEEVHGGSPWGAGTFASGNGSRKVTDLEKAIAKQQGEDFFKTVFK YCR013C_homolog 450bp public: 1..450 (SEQ ID NO 407)
ATGATAACAATGTTACCATTTTCAGCAGATTTGACAGCAGCATCCAATAAGGATTTAGTACCGTTGGCG
AATTTTTCAAATTCGAAAACACCTGGTGGACCGTTCCAAACAATGGTCTTAGCTTTGGCAACAGCTTGT
TGGAACAATTCGACAGATTTTGGACCACAGTCCAAACCCATCCAGTTGTCTGGAATACCTTCAGCATCA
GTAGCAGAAGAAGTTTTTGGCATCTTTGTCGAATTTATCAGCAGTTGACAAAATCAACTGGCAAGATCAAT
TCAACATTGTTTTTCTTAGCTTTTTCAACCAAGTGTTCAACGTTTTTAGCACCGGCTTCATCGAAAAGA
GAATCACCAATTGGCATTTTGTTCAAGATTTTCTTGAAAGTGAAGGCCATACCACCACCAACAATCAAC
ATATCAACCTTGTCCAACAAGTTGTCAATCAATTGA YCR013C_homolog 149aa (SEQ ID NO 408)
MITMLPFSADLTAASNKDLVPLANFSNSKTPGGPFQTMVLALATACWNNSTDFGPQSKPIQLSGIPSAS
VAEEVLASLSNLSAVTKSTGKINSTLFFLAFSTKCSTFLAPASSKRESPIGILFKIFLKVKAIPPPTIN
ISTLSNKLSIN YDL147W_homolog 840bp public: 1..840 (SEQ ID NO 409)
ATGGATAGGAGTTGGGTAGTAGGTTGTGCCATAAAGGGTGGTTGTTTAGTTAGTTATGGCACATGTTGT
GGTAGTTTGATTTTTTTTGTGGTCCACACGACTGGCCAAACATTTATCAAAAAATCGAGTTCAACTTT
TTTTTTTTTTCCAGTTCGCCACCACCAACTACTTTTACCACCACTAACAACATGTCAAGAGAAGATCCA
ATTAAGGCTGAAAAAGACTTTTCTGCTACTTTAGATGAACAATTCCCATTGATTGAAAGATCTCTGAC TACAAGCAAGCATTAGATAAGTATCTTGTCTTGGAGAAACAAACTCGTCAGTCTTCCGATTTGGCTTCA
TCAAAAAGAGTTCTCAACAAGATTGTTACTGCATTGGTTGATAATAACGATTGGGAGTATTTGAATGAC
TTGATAACTATCTTGTCAAAGAAACATGGTCAGTTAAAGTCGTCAATTCAAGCATTTATCAAAGATGTG
ATTGATAATTTGGATAAATTGGATGAAAACAACAAGCAACAATTAGAGTTGAAGATGAAATTGATTGAA
ACTATTAGAACAGTCACAGACAAAAAGATTTTTGTTGAAGTTGAAAGAGCCATTGTTTCAAGACAGTTG
GCCAAAATTTATTTGAACAAATTGAATGATTTGGATAAGGCAGTGGAAATCTTGTGTGATCTACAAGTA
GAAACGTATTCGTTAATGCCATTCAGTGACAAGATTGAGTATATCTTAGAACAAATTCAGTTGACTTTA
CAAAAGGGGGACTATGGCCCAAGCCAAGATTTTGAGTCGAAAGATTTTATTAAAATCGTTGAAGAACTT
TGCCAAAGCTGA YDL147W_homolog 279aa (SEQ ID NO 410)
MDRSWVVGCAIKGGCLVSYGTCCGSLIFFCGPHDWPNIYQKIEFNFFFFSSSPPPTTFTTTNNMSREDP
IKAEKDFSATLDEQFPLIEKISDYKQALDKYLVLEKQTRQSSDLASSKRVLNKIVTALVDNNDWEYLND
LITILSKKHGQLKSSIQAFIKDVIDNLDKLDENNKQQLELKMKLIETIRTVTDKKIFVEVERAIVSRQL
AKIYLNKLNDLDKAVEILCDLQVETYSLMPFSDKIEYILEQIQLTLQKGDYGPSQDFESKDFIKIVEEL
CQS YDR253C_homolog 1752bp public: 1..1752 (SEQ ID NO 411)
ATGCAAAATACTAACCGTAATAATAGTAATAGTAGTAAGAATAATAGTGATAATCATCATCAACAACAA
CAACGACAACGACAACAACAAGTTGATCAATATCAATCTATTACATTACCACCATTACAATATCAATCT
AATACTCACGAATCGATAGTATTACCTTCGCAACAACCTAAAAGAGGTCGATCTGAACATTTTAATTCA
CAATTCCAACGTAATATAAATTCAAGACCAGTGTTATTACCAAGTTCTCGTGATAATAATAACACCACA
AATATACCTATACCTATAATTTTACCAAGTAGTACCAATTCTAACAATCCAATTACTTCTAGTAGCAAT
TCAAGAATGTTTTCACCTAATCCTGTGAGTCCATTATATCCCGTGGTCACCACACCATCATCAGCATTA
TCACCACCAACACAACACCATCAACAACAACAGCAACAATTACATAAAAAATTCAAAACATCAAATTCA
GGTTCCAATACTCCGATTACTGGTGGTGGAATTGGATCTCCTAGTACTACTAGTTATTTAGCTAATTCT
GCTAATATCAGTTATACTAGAAGTCAACCATTAAAAGATAACAACCAAACATCTTCCACAACTAAGGAT
AATAATAACACGATAATTGAAAATGAAGACCAAGATTTTTCCGATTAGCAAAAGAAGCATTAGTAGCT
ACTGCCAAGGGAGTTAAGACGAATCATTCCAATAATAATGGTAAATTTGGTAATAATACTTCTAAGATT
GATATTAATAATCATAATAAGAACAACAACAACAAAAGTGATGGTAATGAAACCATACTTGATTCTACA
ATTGCAGATTTATTAAGAAGATTACAATATGCTAGTGCTCCTCATGGTAATCCCATTGGCCAAATAAGT
GGACTTCAAACTAATTCTAAAGGATTACTTGAAGTACAAGATGAATACTCTAATTTCCCTGATTTACAA
AACAATAATTTTTTCAAAGTTAATAATGGTGATAATAATAATACTAGTAATAGCAAGTTTAGTAATAAT
TATCATCATCCATCAGGTAATGAACCAGGATGGAATTTTTTACTTGATGAAGCATCAACGAAAACAACA
TCAAACAATACACGATCAACAGGAACAACAGGAACAGGAATAGGAGCAACAACCAATATAATATCAGAA
TCAGAATCGGAATTAAAAGTGAAACGAGAATCAAGTATTGCCAATATAATCAATCCCTCAACAACAACA
ACTTCCACAACAACTAATAAGAATAACAATAACACTTCATCATCTACTAAAACTAGAAAATATTCTCAA
GATCCAACAAGAAAATTTCCTTGTGATAAATGTCCCATGTCATTTCGTCGATCATCAGATTTAAAACGT
CATGAAAAACAACATTTAACTATCCCACCTAATATTTGTCAATTTTGTGGTAAAGGTTTTGCTAGAAAA
GATGCTTTAAAAAGACATATTGGGACTTTAACATGTAAAAGAAATGCTGATAAGAAATTATATATTGAA
AATTTAAATTATTTAAATAATTCAAGTCAAGATGATGATGATGATGAAGAGGAGGAGGATGAAGAAGAA
GAAGGATTGGAACAGGATAGATTGTATAAGAAGAGGAGGAAGAGTAATAATAATAATCAAATAATTAAA
GAAGAAGGATTTGAACATAATGATGACGATGATGATGATGATGAAGAGGATGAAGTGAAACGAGAATTT
CCAACTTATGGATATCAACAGAATTGA YDR253C_homolog 583aa (SEQ ID NO 412)
MQNTNRNNSNSSKNNSDNHHQQQQRQRQQQVDQYQSITLPPLQYQSNTHESIVLPSQQPKRGRSEHFNS
QFQRNINSRPVLLPSSRDNNNTTNIPIPIILPSSTNSNNPITSSSNSRMFSPNPVSPLYPVVTTPSSAL
SPPTQHHQQQQQQLHKKFKTSNSGSNTPITGGGIGSPSTTSYLANSANISYTRSQPLKDNNQTSSTTKD
NNNTIIENEDQKFFRLAKEALVATAKGVKTNHSNNNGKFGNNTSKIDINNHNKNNNNKSDGNETILDST
IADLLRRLQYASAPHGNPIGQISGLQTNSKGLLEVQDEYSNFPDLQNNNFFKVNNGDNNNTSNSKFSNN
YHHPSGNEPGWNFLLDEASTKTTSNNTRSTGTTVTGIGATTNIISESESELKVKRESSIANIINPSTTT
TSTTTNKNNNNTSSSTKTRKYSQDPTRKFPCDKCPMSFRRSSDLKRHEKQHLTIPPNICQFCGKGFARK
DALKRHIGTLTCKRNADKKLYIENLNYLNNSSQDDDDEEEEDEEEEGLEQDRLYKKRRKSNNNNQIIK
EEGFEHNDDDDDDEEDEVKREFPTYGYQQN YDR276C_homolog 516bp public: 1..516(SEQ ID NO 413)
ATGTGTTTATGTCTTTCGGATTTATTTCTTATTATTCTTTCAGTATTATTCCCACCATTACCTGTTTGG
ATTAGAAGAGGATGTTGTTCATGTGATTCATTAATTAATATTGCCTTATGTATGTTAGGATATTTCCCA
GGGTTAATTCATTCATGGTATATAATAGCTAAATATTCTTCTTATTATTATCAACAACAACAACAACAA
CGTAAAGATACCATTTATTATGTTTATCGAAGTGATTTAGAAAATCAAACACCAAGAAGAGATGGCAGA
GATGGGAGAGATGAATGTCATCATGACCACCACCACCACCATCATCATCATCACAACCAGGCAGAATCA
CAAAGTGCGGGATTAATAGTTTCTAATAATCATAATAATAATAATAACTATGGATCTGTGGTTGAA GGTTCATCATCATCGAATTTGACTCCTGTGGCTCCTATTCCTGTTGAAAATGGAGCTCCACCACCAGCT
TATACTGAGATTGATAATAAAACACAACATTAA YDR276C_homolog 171aa(SEQ ID NO 414)
MCLCLSDLFLIILSVLFPPLPVWIRRGCCSCDSLINIALCMLGYFPGLIHSWYIIAKYSSYYYQQQQQQ
RKDTIYYVYRSDLENQTPRRDGRDGRDECHHDHHHHHHHHHNQAESQSAGLIVSNNHNNNNNNYGSVVE
GSSSSNLTPVAPIPVENGAPPPAYTEIDNKTQH YEL039C_homolog 333bp public: 1..333(SEQ ID NO 415)
ATGCCAGCTCCATTTGAAAAAGGTTCAGAAAAGAAAGGTGCCACTTTATTTAAAACTAGATGTTTACAA
TGTCACACCGTTGAAAAAGGTGGTCCACACAAAGTTGGTCCAAATTTGCATGGTGTTTTCGGTAGAAAA
TCCGGTTTAGCTGAAGGTTATTCTTATACTGATGCTAACAAGAAGAAAGGTGTTAATGGACTGAACAA
ACCATGAGTGATTATTTGGAAAATCCAAAGAAATATATTCCAGGTACTAAAATGGCTTTTGGTGGTTTA
AAGAAACCAAAGGACAGAAACGATTTAGTTACTTATTTGAAGAAAGCTACTTCTTAA YEL039C_homolog 110aa(SEQ ID NO 416)
MPAPFEKGSEKKGATLFKTRCLQCHTVEKGGPHKVGPNLHGVFGRKSGLAEGYSYTDANKKKGVEWTEQ
TMSDYLENPKKYIPGTKMAFGGLKKPKDRNDLVTYLKKATS YER112W_homolog 321bp public: 1..321(SEQ ID NO 417)
ATGTCAGCAGGTATTCCAGTAAGACTTCTAAATGAAGCACAAGGTCATATAATATCAATAGAATTGATA
AATGGAGATACATACCGTGGGAAGCTATTAGAAAATGAAGATAATATGAATTTATCCTTATACGAGGCA
ACTATAACACAAGGCAAATCGGGGAAAGTAAGTCATATGGACCAAGTGTTTATAAGAGGGTCAATGATT
AGATTTATATCTGTGCCTGATATTTTAAAGAATGCTCCTATGTTTTTTATGAAACCTGGAGATAAACCA
AAACCTCCAATAAGGGGCCCTCCACCAAAAAGAAAGAGAGTATGA YER112W_homolog 106aa(SEQ ID NO 418)
MSAGIPVRLLNEAQGHIISIELINGDTYRGKLLENEDNMNLSLYEATITQGKSGKVSHMDQVFIRGSMI
RFISVPDILKNAPMFFMKPGDKPKPPIRGPPPKRKRV YFR010W_homolog 1239bp public: 1..1239(SEQ ID NO 419)
ATGGTTTTAGGCACTCCAGACAAGAATTTGCCTTCAAAGCCAGTTGAAAAACAAGTTTTTCTCGAAGAT
TTGAATAAAAATCAATTGGTTAAAGTTAGTAATGAACCTAGTGGGTTGACCAATTTAGGGAACACTTGT
TACTTGAACTCAAGTTTACAAACAATATTCCATATTGATGATGTGAATAACAGGTTGAAAGATTACACT
TTTGGTGGAGCCAATCAAGCCAATAGTGCCTTTGTGTTGTCATTGAAAAGTATGTTCCAGCAAATGTCG
AAAAAACAAGAAGTTATAACTCCTTCTACATTTCTTTCTCTTTTCAGAAGATCTTATCCTCAATTTGCT
GAACAACAAAATGGTATTTATAAACAACAAGACGCCGAAGAAGCATTTTCCCAAATTTTGAGCTCTTTG
AGAAGCGAATTGAAAATAGATGATGTGTTCAAAATTACATTTAACACCAAGACTCAATGCTTGGCTATT
CCAGAAGATGTCACAGAAGGGTTTGAAGAAGCATATAAATTGAATTGTCATATCGGCGTCAAGACCAAT
TTTTTGAGAGATGGATTGTTGGCTGGATTAAAAGAAACGATTGAAAAACATAATTCAACTTTGAATGCT
GATACTGAGTATGAAACAACCAAGACCATAACTAGATTACCAAAATACTTGACAGTACATTTTATTAGA
TTTTTCTGGAAACGAGACATCAATAAGAAATCCAAGATTTTGAGAAAGGTTCAATTCCCATTTGAATTA
GATTTAGCAGAAATGTTGGATGTATCAATAAAGGCAGATAAAGTTTCCAATAGAGATACAATTAGAAAA
GTTGAAAAAGATAATTTGGATATGATAAGAGATTTCAAAAAGACCAAAAATGACACCAGTTTAACACCA
TTGGAACAACAAGAGGAGGATGAGATGAAAATAACATCAATCAAGAGTAAGTTTAAAGACGACTTGAAT
AGCGCTTTGCCCAACGTTGATTTTAACACCACCACAGAAAACCCTTCTAGTGTGTATGAATTAAACGCA
GTCATTACTCATGCTGGATCATCTGCCGATGGTGGTCATTATAAAGCATACGTCAAGGATCCAACAGAC
TTGGATGGCGAGAGATGGTGGTTATTTAACGATGATAAGGTGAGCTCCGTAAACAAAGAAAAGATCGAA
ACTTTAGCTGGCGGTGGTGAAAGCGACTCAGCTTTATTATTGATTTACAAAGGCTTAGGGCTTTAG YFR010W_homolog 412aa(SEQ ID NO 420)
MVLGTPDKNLPSKPVEKQVFLEDLNKNQLVKVSNEPSGLTNLGNTCYLNSSLQTIFHIDDVNNRLKDYT
FGGANQANSAFVLSLKSMFQQMSKKQEVITPSTFLSLFRRSYPQFAEQQNGIYKQQDAEEAFSQILSSL
RSELKIDDVFKITFNTKTQCLAIPEDVTEGFEEAYKLNCHIGVKTNFLRDGLLAGLKETIEKHNSTLNA
DTEYETTKTITRLPKYLTVHFIRFFWKRDINKKSKILRKVQFPFELDLAEMLDVSIKADKVSNRDTIRK
VEKDNLDMIRDFKKTKNDTSLTPLEQQEEDEMKITSIKSKFKDDLNSALPNVDFNTTTENPSSVYELNA
VITHAGSSADGGHYKAYVKDPTDLDGERWWLFNDDKVSSVNKEKIETLAGGGESDSALLLIYKGLGL YFR052W_homolog 834bp public: 1..834(SEQ ID NO 421)
ATGTCTTTACAAAAACTCACTGCAGAAATATACTCACTATTTGGAAAAGGAGATTATCAAGGTTGCCAA
CAATTACTTGCTCCGATTAAACTAGAATTAGTCAAACATGATTTGTTGGTTCCTTTACCATCCAACACC ACCGATAAAAACCAAATTAATGATTTGAGAATTGCCCAAAGAATTTTTGGAAATTGGAGCATTATCGTCA
TTATTAACCAACAACTATTCCGGTTTTGAGAATTATTTTGCTCAGTTGAGACCATTTTACTCTAACCCC
AAATTACATAATTTACAAAAAGTCCATATCAATACCGATATAACAAAAATCATTTCATTATACTTGTTA
TACTTGTTGAGTCAGGGTTTGATTTCAAAATTCCATGTTGAACTAGAAGTGATTTATAATTCATCACAA
TATGATGCCCAACAAGACAAGTATTTACAATTTCCAATAAATTTAGAAAGCAATTTAATGGAAGGTAAT
TACATAAAAATCTGGAAGTTATTAAAAGAAGAGAAAAACTTACCATGTCAAGAATACACCCATTTTGTT
GATACTTTGATAAATGCTTTACGTTTTGAAATTGCCAAATCTTTGGAGAAAACTTACGATTCGATTCCA
ATTTCTAATTGCAAGAATTTATTATATTTACCACAAGAATTGTCCGATGCTAACTTTGAGAAAACTTTA
AAGGAAACTTATCAAGTTGATAATTGGAAATTCGAGGATGGAGTTATATATTTCACTAAGAATGAAAAT
GAAACCAATGTTGATAACCAATCGGTTATAAAGAATTTATTAGGGTACGCTGAACAAATCGAATCCATC
GTATAA YFR052W_homolog 277aa(SEQ ID NO 422)
MSLQKLTAEIYSLFGKGDYQGCQQLLAPIKLELVKHDLLVPLPSNTTDKNQINDLRIAQRILEIGALSS
LLTNNYSGFENYFAQLRPFYSNPKLHNLQKVHINTDITKIISLYLLYLLSQGLISKFHVELEVIYNSSQ
YDAQQDKYLQFPINLESNLMEGNYIKIWKLLKEEKNLPCQEYTHFVDTLINALRFEIAKSLEKTYDSIP
ISNCKNLLYLPQELSDANFEKTLKETYQVDNWKFEDGVIYFTKNENETNVDNQSVIKNLLGYAEQIESI
V YGL080W_homolog 354bp public: 1..354(SEQ ID NO 423)
ATGTCATCATTTAAAAAATTCACTGATTTTTTATTTTCAAAACAATCCCTTAGATATGTCTGTACAACT
CATTTTTGGGGTCCAGTATCAAATTTTGGGATTCCTATAGCTGCTATTTTAGATTTGAAAAAAGATCCT
GATTTAATTAGTGGACCAATGACTGGTTCATTAATACTTTATTCTTTAGTGTTTATGAGGTATTCAATG
GCAGTTACTCCTCAAAATTATTTATTATTTGGGTGTCATTTTGTTAATGAATTGGCACAATTGAGTCAA
GGATTTAGATGGGTTAAACATCACTATGATACTTCTTCAAATGATGGTGAAGATACCAAAAAGATAACT
CAAAATTGA YGL080W_homolog 117aa(SEQ ID NO 424)
MSSFKKFTDFLFSKQSLRYVCTTHFWGPVSNFGIPIAAILDLKKDPDLISGPMTGSLILYSLVFMRYSM
AVTPQNYLLFGCHFVNELAQLSQGFRWVKHHYDTSSNDGEDTKKITQN YGR070W_homolog 4146bp public: 1..4146(SEQ ID NO 425)
ATGTCGAGTAATAGTTCTTGGTCTAACAACGATTCTTACCAACTGAGGAACAATCCTAATAATGGTAAT
AACCATAACCCACATTTAATGTCACAACAACACTCACAATCTGTAAATATTCCTTCTCATTTGTTGCCT
CAAGCATTTATAGAACAACAACAACAACCACCACAACCACAACCACAACAATATCCGCAAGACGGCCAA
GCTCATAACAAAAACCCACCCAATCAATAATCGTTTTCATCAATCACAACCACCACAACTGCCGCATCAA
TACATCCCATCCAAACAAGAACAAATGCAACAACCTTACCCAACTGCCGAACAAAATAATCAACACTTT
CCTCCACCACAGGAAAGATCATATAGTTTTTCATCGACTATGGATCCTGGCTCACCTAGCAAAATGACG
CCACCTAATTTTTCACAAAGGAACCAATCATTTCTGGCTACCAACAACCACCACCACAACAACAACAG
TATCCGCAGTCACCCCATAAGGCATATAACCAACAAACCCACACTCACCAAGGTGGACTTCAACAGCCA
TACATTGCGCAAAGACAAAACATGCCACCTGGATATATTAACCAGAATCCATATTCTCAGCAAAATAGA
TCAGTATCATCTTTGACTCAAGATAGGACAGGAGCACCAGTACAACACCTTCCTTATCCTGTCAACAAT
GATGATCCTGGATATCAACTACAACCACTGGCAATTCAATCACACCACCCACCACAACAACAACAACAA
CAACAGCCTCCACTCCAGACACGTAGACAACTTCGTAAGGCCCCTTCGAGCAACTTGCCCCCAATTCAA
ACTGATCAAGTTTACTATAGCCCTGATGCTAGAAGAATTGTTTCCACACCTACACACCAGCAGAATTTT
CCCACTCCCATACCACCAGAAGCTAGAACAAAATCACTTACTTCGGCATCATTAAAACACCAGAAACAA
CCACTGCAACCTCTGCAACCATATTTCCAACAAATCTCTGAACTGCCAGGTAAAGACAGCAACGCTCGT
AATTCCTCCAGCAGTTCCCTTCATCATACATTTTCCTTAACCTCAAAATCGCGATCATTTACATCTATC
AGTAAATTGTCGTCTTTATCAACTAAGAAATTCGGTTCCTCTTCATCCGTCAATACCAACAAATTAGAT
CGTTATCAATCCAGTGGAACTATTAGAAACAATCACAATCATAACCACACCAACCAAACTAGCCACAAC
ATTCATTATGCTAAACCATCAGTATATCCCGCAATTTTATCTGAAGTGGCCAAATTGTTTAAAGAGGCG
ATTATTTTGACGATCAACACCAAGGATGGTTTGGAATACCATGATACTTTTACCGGGAAAATGGCAGTT
GATATATTATGTCGCATTATTCGAACAAATGATCGTAACTTGGCCTTGTTATTGGGAAGATCATTAGAC
GCTCAGAAGTTTTTCCATGATGTTACTTACAATCATAGATTAAGGGATTCGGTACATGAAATTTATGCC
TTTAACAATGTTTATAATGATGTTGATTTTTTCAACGAAGAAAATGGAGGAGCTGGTCTGGTTAGCAAT
GGGGAAAATAGTGCATTAAATTCCAAACATGGGTCGTTTCTTGATAGCAGCACACAGTTACAGAATGCT
TTGAATGACCATATATCCGATTATCATACCTCACAAAGCAGTGGATCATTAACTAAAATTGCTAGTAGT
GCCACTGGTAATGGTTCAGTAGGTGTTGCTGGTAAGGAGTTGAGTGCAAGTCAACAAACAGGTGTTAAT
GGAGTTTTCACTATTTTGACAGAATGTTATTCGCCCACATGTAGCAGAAATAGTCTTTGTTACAGTATT
GCCTGTCCAAGAAGATTAGAGCAACAAGCTAGATTAAATTTGAAACCTCAAGGTGGTTTGCAACGTGCT
GTTTCAAAATTATCATTGCATGATCAGGAAGAAACCGAAACTTTATGGCACAAGACTGTACCTCAATCA
GTTTTAGATAAATTAGACAAGCATGAAAAGACTCGACAAGAATTGATTTATGAATTTGTTTATACTGAA
CGTGACTACGTCAAGGATTTGGAATTTATGACTGATTTCTACATTATGCCGTTACGAAATCCTGCCAAT AATATTATTCCTGATTACCAAAGAGAAACATTTATTCAAACTGTGTTTGGGGGAGTGCCTGATTTGTTG
AGATTGGCCAAGAGACTCAGTGAAGCATTAACTCGAAGACAACAACAACAAAAGCCCGTTATTGAGACC
ATTGGTGATGTATTTTTAGATTATGTTGGTGATTTTGAACCTTTTGTGACATATTCTGGAAATAAAGTG
TTTGCTACTTTTGAACATGAAAGACAACAACAAGTTAATATGAAATATGCTAGATTCTTAGATGCGATT
GAAAAGAAACCAGAATCGAGAAGACAACAAGATTTATCATCTTTTTTAATTAAAGGGGTTCAAAGACCAGCA
AGATACCAGTTATTGTTATCGGGTATTTTGAAACATACCAAGCCAGAGTCACCCGACTACAAGTATTTG
ACGAAAGCAAAAGAAGAGATTGAGAAATTATTGGTGAAAATCAATATCCAAACTGGGGAATGTACTGAT
CGACACAAAGTCATGGTTTTGCATAGGTTATTGGGCAAACAAACTTTGGAAAATAGGTTTAATTTCAAA
TTATCCTACAATAATCGTATTATCTATCAAGTGACTTTGAATAGAAAGAGGGATAACGAAAAAATTGAT
TTATACTTGTTTGAACATGCGTTGTTATTAGTGAAACACAAGATTCAAAACAAGCGTGAACAACATAAA
GTATTTGAAAAACCAATGTATTTACCATTGTTATTTGTCAATAGTGGTATGGAGATCCCCACTAATAGA
ACAATCATGCCTCATAGATACCATGGATCCTTGGTATCTGATACTAGTATAAGACCTCAAAGAGCAGAA
TCTAATTATATTGGTAATACTTTGAATTCTTCATCAACACCTAAATTCCAATTGAATTTTTTTGGGTTA
GGTAGTAATCAAGTTCACGCCTCATTATTTGCTGATGACTTGACTATTCAGAACCAAGTGTTGCTGCAA
ATATCGGCCCAACAGAAGAAATTAATTGATGCTAATGACATTTTTTCATTGTGTAAATTTGAAACGAGA
AGATTCACTGGGAATAATAAAATCAATTGTGCTGTTCCTTGTTATGGTGGGAAGAAATTGTTGTATGGT
ACTGATTCAGGGGTATGGGTTAGTACTGTTCGTTCAATTAGTGCCACATCTAATGAAAAAATCTGTAGT
GATCCCACTATGGTCATTTCCAAAACTTATGTCACTCAAATTGAAGTGATTGTTGAATACTCCAAGTTG
TTAGTATTGAGTGACAAATCATTATATGAATTTGATTTATCTTGTACCGATTCTTTGGATCATGTGAAG
AATACCAAACTGGGGAAATTGCTTTTGAGTCATGTGTCATTTTTCAAAGTTGGTGTTTGTGATGGGAAA
TTGCTAGTGATTGGTGCTAGAACAGGTAGTCTGCATTCAATTTGTATATTTGAGCCTGTTAATCCATTT
GATAAATCGAATAAGAATAAGAACAAGAGATTAGAAATTCAAGAAATTAATTTCAGTTCTGATCCAATT
TCCATCTCATTTTTGAAGACTAAACTTTGTATTGGGTGTGCTAAAGGTTTTGAAATTTTATCTTCTCAA
ACAGGAACCAAAGAATCGATTTTGGATGAAGCAGACCCTTCATTAGATTTTGCAACACAAAGAGAAAGT
GTGACACCATTAGCAATTCATCGATTAGGACGTGATTTCTTATTGTGTTATTCTGAATTTGTATTTTTG
ATCAATCGAAATGGATGGAGAACAAATCATGATTGGGGGATATTTTGGGAAGGTAATCCACAAAATGTT
GCGATTTTCTTCCCTTACTTGCTATCATTTGAACCTGGATTTGTTGAAATTAGAGATTTGCATACAACT
AATTTATTAAGAGCTTTAACGGGAGAGAATATTAGATTTTTGCATTCGAACGAACATGAAGCTATGTTT
GCTTGTGAAGAAAATGGATATGATATTATTATTTCCATTGATTTCTTGAATTTGAAACCAAAGTCTCCA
ACATAA YGR070W_homolog 1381aa(SEQ ID NO 426)
MSSNSSWSNNDSYQSRNNPNNGNNHNPHLMSQQHSQSVNIPSHLLPQAFIEQQQQPPQPQPQQYPQDGQ
AHNKNPPINNRFHQSQPPQSRHQYIPSKQEQMQQPYPTAEQNNQHFPPPQERSYSFSSTMDPGSPSKMT
PPNFSQRNQSFSGYQQPPPQQQQYPQSPHKAYNQQTHTHQGGLQQPYIAQRQNMPPGYINQNPYSQQNR
SVSSLTQDRTGAPVQHLPYPVNNDDPGYQLQPSAIQSHHPPQQQQQQQPPLQTRRQLRKAPSSNLPPIQ
TDQVYYSPDARRIVSTPTHQQNFPTPIPPEARTKSLTSASLKHQKQPSQPSQPYFQQISESPGKDSNAR
NSSSSSLHHTFSLTSKSRSFTSISKLSSLSTKKFGSSSSVNTNKLDRYQSSGTIRNNHNHNHTNQTSHN
IHYAKPSVYPAILSEVAKLFKEAIILTINTKDGLEYHDTFTGKMAVDILCRIIRTNDRNLALLLGRSLD
AQKFFHDVTYNHRLRDSVHEIYAFNNVYNDVDFFNEENGGAGSVSNGENSALNSKHGSFLDSSTQLQNA
LNDHISDYHTSQSSGSLTKIASSATGNGSVGVAGKELSASQQTGVNGVFTILTECYSPTCSRNSLCYSI
ACPRRLEQQARLNLKPQGGLQRAVSKLSLHDQEETETLWHKTVPQSVLDKLDKHEKTRQELIYEFVYTE
RDYVKDLEFMTDFYIMPLRNPANNIIPDYQRETFIQTVFGGVPDLLRLAKRLSEALTRRQQQQKPVIET
IGDVFLDYVGDFEPFVTYSGNKVFATFEHERQQQVNMKYARFLDAIEKKPESRRQDLSSFLIKGVQRPA
RYQLLLSGILKHTKPESPDYKYLTKAKEEIEKLLVKINIQTGECTDRHKVMVLHRLLGKQTLENRFNFK
LSYNNRIIYQVTLNRKRDNEKIDLYLFEHALLLVKHKIQNKREQHKVFEKPMYLPLLFVNSGMEIPTNR
TIMPHRYHGSLVSDTSIRPQRAESNYIGNTLNSSSTPKFQLNFFGLGSNQVHASLFADDLTIQNQVLSQ
ISAQQKKLIDANDIFSLCKFETRRFTGNNKINCAVPCYGGKKLLYGTDSGVWVSTVRSISATSNEKICS
DPTMVISKTYVTQIEVIVEYSKLLVLSDKSLYEPDLSCTDSLDHVKNTKSGKLLLSHVSFFKVGVCDGK
LLVIGARTGSSHSICIFEPVNPFDKSNKNKNKRLEIQEINFSSDPISISFLKTKLCIGCAKGFEILSSQ
TGTKESILDEADPSLDFATQRESVTPLAIHRLGRDFLLCYSEFVFLINRNGWRTNHDWGIFWEGNPQNV
AIFFPYLLSFEPGFVEIRDLHTTNLLRALTGENIRFLHSNEHEAMFACEENGYDIIISIDFLNLKPKSP
T YGR132C_homolog 966bp public: 1..966(SEQ ID NO 427)
ATGCTCATTATTGACACCAAAATAATTTCTTCACCTTTTTTTTCTTCCTTTTCTTTCTTCAAGACAAGC
ACAGTTTCTTCCCCTCTGCTACTGCTAAACGTCCAATCAAACACTATGTCACAACGAATTGCAGATTTT
GTTTCTAAAATAGCCTTGCCAGCTGGTATCACCATTGCATTGGCACAATCAGCCTTGTATGATGTTCCT
GGGGGTAAGCGTGCAGTTATATTTGACCGTTTAAAGGGGGTCAAACAGGGAGTTATTGGCGAAGGTACC
CACTTTTTGGTGCCATGGTTACAAAAGGCAGTGATATTTGATGTTAGAGTTGAACCACGAGTAATTACT
ACCACTACAGGATCTAAGGATTTACAGAATGTTTCATTGACATTGAGGGTGTTGAGTAGACCCGAAGTA
AGAAAATTGCCTACTATTTACCAAACTTTGGGGTTGGATTACGGGGAAAGGGTGTTGCCTGCCATTGGT
AATGAAATTTTGAAATCGATTGTGGCACAATTTGATGCTGCTGAATTGATCACCCAGAGAGAGGTTGTT

```
TCTGCCAGAATAAGACAAGAGTTGTCAAGAAGAGCCGCAGAGTTCAATATAGAATTGGAAGATGTGTCG
ATTACACATATGACATTTGGTAGAGAGTTCACCAAAGCCGTGGAAAAGAAACAAATTGCACAACAAGAT
GCAGAAAGATCAAAGTTCCTTGTGGAGAGAGCAGAACAGGAAAAGAAGGCTGCGATTATCAGAGCTGAA
GGGGAGGCCGAATCAGCAGACGTTGTTTCCAAGGCGTTGGCCAAAGCTGGGGATGGGTTATTGATGATC
AGAAGATTGGAGGCATCAAAGGACATTGCATCAACATTGGCCAACTCACCAAATATCACTTATTTACCT
AATGGTGGCGCTGGCGGCAGCGATAGCGACGGGTCCAAAAACTCATTATTGTTGAATATTGGCCGTTAA
```

YGR132C_homolog 321aa (SEQ ID NO 428)
```
MLIIDTKIISSPFFSSFSFFKTSTVSSPSLSLNVQSNTMSQRIADFVSKIALPAGITIALAQSALYDVP
GGKRAVIFDRLKGVKQGVIGEGTHFLVPWLQKAVIFDVRVEPRVITTTTGSKDLQNVSLTLRVLSRPEV
RKLPTIYQTLGLDYGERVLPAIGNEILKSIVAQFDAAELITQREVVSARIRQELSRRAAEFNIELEDVS
ITHMTFGREFTKAVEKKQIAQQDAERSKFLVERAEQEKKAAIIRAEGEAESADVVSKALAKAGDGLLMI
RRLEASKDIASTLANSPNITYLPNGGAGGSDSDGSKNSLLLNIGR
```

YGR135W_homolog 756bp public: 1..756 (SEQ ID NO 429)
```
ATGTCAAGAAGATACGATTCAAGAACCACTATTTTTTCACCAGAAGGTAGATTATACCAAGTGGAATAT
GCTCAAGAAGCCATATCCAATGCTGGTACAGCCATAGGGATATTATCTCCTGAAGGTGTCGTTTTAGCG
TGTGAAAAGAAAGTCACCTCCAAGTTATTGGACGATGATGGATCAGCTGAAAAATTATACATTATCAAC
GATCAAATGATTTGCGCTGTTGCTGGTATGACTGCCGATGCATCAATTCTTGTGAATAATGCAAGAATT
CAAGCCCAACAGTATTTGAAGTTGTACGACGAAGAGATTCCTTGTGAAATGTTGATCAATCGTGTTTGT
GATGTCAAACAAGGTTATACCCAACATGGTGGGTTGAGACCATTTGGTGTTAGTTTCCTTTATGCCGGG
TATGATGACAGATATCAATTCCAATTGTTTACATCGAATCCTTCTGGTAATTACAGTGGTTGGAAGGCA
ACTAGTATTGGTGCTAACAATTCTGCTGCTCAAACTTTATTGAAGAAAGATTACAAGGACGATTTGACT
TTAAAAGATGCATGCGAATTGGCTATCAAGGTTTTATCAAAAACTATGGATGCTTCAAACATAAATAGT
GAAAAATTAGAATTCGCTACCTTAAGTTTGGGCAAAGACAACAAAGTGTTGCATAAAATTTGGAACGAT
AAAGATATTGACATCCTAATTAAGGCTTCGGGGGTTTTGAACGAAAAAAATAGCGATGATGAATAG
```

YGR135W_homolog 251aa (SEQ ID NO 430)
```
MSRRYDSRTTIFSPEGRLYQVEYAQEAISNAGTAIGILSPEGVVLACEKKVTSKLLDDDGSAEKLYIIN
DQMICAVAGMTADASILVNNARIQAQQYLKLYDEEIPCEMLINRVCDVKQGYTQHGGLRPFGVSFLYAG
YDDRYQFQLFTSNPSGNYSGWKATSIGANNSAAQTLLKKDYKDDLTLKDACELAIKVLSKTMDASNINS
EKLEFATLSLGKDNKVLHKIWNDKDIDILIKASGVLNEKNSDDE
```

YGR155W_homolog 1491bp public: 1..1491 (SEQ ID NO 431)
```
ATGACATCTACAAACAAACCACCAGCCTTAAAAGAAGATATTTTAGAACTTATTGGTAATACTCCATTA
GTCAAATTGAACAAAATTCCACAATCGTTGGGAATTAAAGCCAAGGTCTATGCCAAAGTTGAATTATTC
AATGCCGGAGGATCAATTAAAGATAGAATTGCCAAAAATATGGTATTGGAAGCCGAAAAACAAGGTAAA
ATCAAACCAGGCTATACTTTGATTGAACCAACCTCAGGTAATACTGGTATTGGTTTGGCTTTGGTTGGT
GCCGTTCGTGGATACAGAACCATCATTACCTTACCAGAAAAAATGTCAAACGAAAAAGTTTCTGTTTTG
AAAGCCTTAGGTGCTGAAATCATTAGAACTCCAACTGAAGCTGCATGGGACTCTCCAGAATCTCATATT
GGTGTTGCTAAAAAATTGGAAAAAGAAATACCAAACTCTATTATTTTGGACCAATATGGTAACCCAGCC
AACCCAGATGCTCATTATTATGGTACTGGTTATGAAATTTGGGAACAAACTGAAGGTAAAATTACTCAC
TTGGTTGCTGGTGCTGGTACTGGTGGTACCATCACTGGTATTTCCAAATACTTGAAAGAAAAAATTCT
AAGATTCATGTTACTGGTGCTGACCCAAAAGGTTCTATTTTAGCTGAACCAGAATCTTTAAATAATTCC
ACCGAAGGTTACTTGGTTGAAGGTATTGGTTATGATTTTATTCCAGATGTGTTGAACAGAAAATATGTT
GATGATTGGATCAAAACAGATGATGCTGAATCTTTTAAATTGGCTAGAAGAATTATTAGAGAAGAAGGT
ATTTTGGTTGGTGGTTCTTCTGGTTCTGCCCTTACAAGCTGCTTTACAAGTAGCTAAAGACTTGACTGAA
GACGATACTGTCGTTGTTGTTTTCCCAGATTCCATCAGATCTTACTTGTCTAAATTTGCCGATGACGAA
TGGTTAATCTCCAATGGATTCGAAGTTGAAGATTCACCGGGTGCTAACAAGGCTGACGAATTCTTGAAT
GGTAAGACTATCAAGGATTGGTTGCTGGCAAAGCTCCAGTTGTCACTGTCACTTTATCTGACACAGTT
GCCAAGACTTTTGATTTATTGCAATCCAATGGGTTTGATCAATTGCCAGTTTTGAATAACTCTGGAAGA
TTAGTTGGTTTGATCACCTTATCCAAGATATTGAAATCTTTATCCACTAAAAAGATTCAAACGACCAAT
TCAATCAGTTCGATCATCATTGATTTCAGAAAGTTGGCTGATTTTGAAAAATCTTTCACCATCACTAAA
AAATCAGGATTCACTAAGAGAAGTTATGAACCAATCAAGTTGGACACCCCATTAGCTGCTTTGAATAAA
TTCTTTGAAACCAATTCAAATGCTATAATCACAGATGATGAATTGAAACCAGTTCAAATTGTTACTAAG
GTCGATTTGCTTTCGTATTTGACTAAAAACGCTAGTTTTTAA
```

YGR155W_homolog 496aa (SEQ ID NO 432)
```
MTSTNKPPALKEDILELIGNTPLVKLNKIPQSLGIKAKVYAKVELFNAGGSIKDRIAKNMVLEAEKQGK
IKPGYTLIEPTSGNTGIGLALVGAVRGYRTIITLPEKMSNEKVSVLKALGAEIIRTPTEAAWDSPESHI
GVAKKLEKEIPNSIILDQYGNPANPDAHYYGTGYEIWEQTEGKITHLVAGAGTGGTITGISKYLKEKNS
KIHVTGADPKGSILAEPESLNNSTEGYLVEGIGYDFIPDVLNRKYVDDWIKTDDAESFKLARRIIREEG
ILVGGSSGSALQAALQVAKDLTEDDTVVVVFPDSIRSYLSKFADDEWLISNGFEVEDSPGANKADEFLN
```

GKTIKDLVAGKAPVVTVTLSDTVAKTFDLLQSNGFDQLPVLNNSGRLVGLITLSKILKSLSTKKIQTTN
SISSIIIDFRKLADFEKSFTITKKSGFTKRSYEPIKLDTPLAALNKFFETNSNAIITDDELKPVQIVTK
VDLLSYLTKNASF

YHR138C_homolog 384bp public: 1..384(SEQ ID NO 433)
ATGAATCAAAATAAGAAATTAACTGGTTTAATATTATTAGCGATTATATCAATCATTACTTTATTCAAC
TTTAAAACAATTTCCCAAATAACTGCCATCAGATCATTTGTCTCCCCTGCCTCTTCCACCGCTACTAAT
ACTAATACTAAATCAACAATGTCAGATTCCAAAGGTTACATTATCACTTTGAAAGATACTTGTGCTGAT
TCCGAAGCTAGTTCAATTAAATCAAAGATTACTGAATTGGGAGGTAAAATCACTAATGAATTTAGTTTA
ATCAAAGGATTTTCTGCTCAATTGCCAACTATCCATGCTGAAGCTTTACCTAAAGATTTTGCTGGTATT
GCCAATATTGAAGAAGATGGTGAAGTTCGTACACAATAA YHR138C_homolog 127aa(SEQ ID NO 434)
MNQNKKLTGLILLAIISIITLFNFKTISQITAIRSFVSPASSTATNTNTKSTMSDSKGYIITLKDTCAD
SEASSIKSKITELGGKITNEFSLIKGFSAQLPTIHAEALPKDFAGIANIEEDGEVRTQ YHR179W_homolog 1212bp public: 1..1212(SEQ ID NO 435)
ATGACAATCGATAACGAAGGCATTGTCATTAAACCATTGGGTTCAACAAAATTATTCCAACCAATAAAA
CTTGGTTTTAACACTTTATCACAAAGAATAGCATTTGCACCATCCACACGTTATAGAGCAACCAAAGAT
AATATCCCTACCGATTTACAATTAGAGTATTATTCTCAACGATCAGAATATCCTGGAACTTTAATCATT
ACTGAAGCAACTTATACATCACGTCAAGGTGGATTAGTACCATATGTTCCTGGGATTTATAATGATGCT
CAAACTAAAAGTTGGAAGAAAATTAATGATGCGATTCATGCCAATGGAAGTTTCAGTTCAGTTCAATTG
TGGTATTTAGGTAGAGTTGCTAATCCTAAAAATTTGAAAGATGCTGGATTACCATTTGTTGGAGCCTCA
TCAGTTTATTGGAATGAAGAAAGTGAAAAATTGGCCAAAGAAGCTGGAAATGAATTGAGGGAATTGACA
GAAGAAGAGATCGATCACATTGTTGAAGTTGAATATCCGAATGCTGCTAAACGTGCCATTGAAGCAGGA
TTTGATTATATCGAAGTGCATTCAGCTCATGGTTACTTGTTAGATCAATTTTTAAATCTTGCCTCTAAT
AAAAGAACTGATAAATATGGTTGTGGTAGTATTGAAAATCGTGCTCGTTTATTATTAAGAATTATTGAT
AAATTGATTGATATAGTTGGAGCTGAAAGATTAGCTATTCGTTTATCACCATGGGCCACGTTCCAAAAT
GTTGACGTCGAAGGAGAAGAAATTCATAGTTATATCATTGATCAATTACAAGAAAGGGCAAATTCTGGT
AATGAATTAGCGTATATTTCTCTTGTTGAACCACGTGTTCAAGCAAGTTGGGATATTGCTAAAGAGAAT
CAAGTTGGCTCAAATGAATTTATTTTGAAACATTGGAAGGGGAAAGTAATTAGAGCAGGTACTTATGCT
CATGAATTAAATAAAATTAATGAAGATATTAATAATGATAGAACTTTAATTGCCTTTTCAAGATTTTTC
ATTTCTAATCCTGATTTAGTGAAAAAATTACATGATGGGATTTCTTTGACTCCTTATGAAAGAGCAACA
TTTTATAATCATGATAATTTTGGATATAATACTTGGATTAAATATGGAGAAAATAAAGTTTTCAATGAA
CAAGAAGAAAGGAAAAAATTGGGTAAACCTTTAGCTTAG YHR179W_homolog 403aa(SEQ ID NO 436)
MTIDNEGIVIKPLGSTKLFQPIKLGFNTLSQRIAFAPSTRYRATKDNIPTDLQLEYYSQRSEYPGTLII
TEATYTSRQGGLVPYVPGIYNDAQTKSWKKINDAIHANGSFSSVQLWYLGRVANPKNLKDAGLPFVGAS
SVYWNEESEKLAKEAGNELRELTEEEIDHIVEVEYPNAAKRAIEAGFDYIEVHSAHGYLLDQFLNLASN
KRTDKYGCGSIENRARLLLRIIDKLIDIVGAERLAIRLSPWATFQNVDVEGEEIHSYIIDQLQERANSG
NELAYISLVEPRVQASWDIAKENQVGSNEFILKHWKGKVIRAGTYAHELNKINEDINNDRTLIAFSRFF
ISNPDLVKKLHDGISLTPYERATFYNHDNFGYNTWIKYGENKVFNEQEERKKLGKPLA YIL074C_homolog 1392bp public: 1..1392(SEQ ID NO 437)
ATGTCATCTCCTCAACAAATTGTCAACTCATTCCAACAAGCCTTGAATTTATCAGGATCTCCAAATGCT
GTTTCTACATCACCAACTCAATCATTCTTGAGTCAATATGTTCCAAGCAAGCCAGCTAAAGCTTTGAAA
CCTTTCAAAACTGGTGATCATCAAAATTTTATTATTGGAAAATGTTAACCAAACTGCCATAAATATTTC
AAAAACCAAGGTTACCAAGTTGAATTTTATAAATCATCATTACCCGAAGATGAATTATTAGAGAAAATC
AAAGATGTTCATGCCATTGGTATTAGATCAAAGACTAAATTAACAGAAAAAATCCTTAAAGCTGCTAAA
AACTTGGTGGTTATTGGTTGTTTCTGTATTGGTACCAATCAAGTTGATTTGGAATTTGCTGCCAAATCA
GGTATCGCTGTTTTCAACTCTCCATTTTCAAATTCTAGATCAGTTGCTGAATTAGTCATTGCTGAAATC
ATTACTTTGGCTAGACAATTGGGTGATCGTTCAATCGAATTGCACACTGGTACTTGGAATAAAGTCAGT
GCCAAATGTTGGGAAATCAGAGGTAAAACTTTGGGTATTGTAGGTTATGGTCACATTGGTTCCCAATTA
TCTGTCTTGGCTGAAGCTATGGGTATGAATTGTATCTATTATGATGTCATGACCATTATGTCTTTAGGT
AACTCGAAACAAGTTGAAAGTTTGGACGAATTGTTGAAAAAGCCGATTTCGTTACTTTGCACGTCCCA
GCTACTCCAGAAACCAAGAACTTGTTGAGTGCTCCACAATTTGCCGCTATGAAGATGGTGCTTACGTT
ATAAATGCTTCTAGAGGTACTGTTGTTGATATCCCAGCTTTGGTTCAAGCCATGAAAGCCGGAAAAATT
GCTGGTGCCGCTTTAGATGTTTACCCTCATGAACCAGCAAAGAATGGTGAAGGTTTATTCAGTGATAGT
TTGAATGAATGGGCCAGTGAATTGTGTTCATTGAGAAATGTGATTTTGACTCCACACATTGGTGGTTCT
ACCGAAGAAGCCCAATCTGCTATTGGTATTGAAGTTGGTAATTCATTGACCAAATACATCAACGAAGGT
GCCTCTCAAGGTGCTGTTAACTTCCCAGAAGTTTCATTGAGACCATTAGATTTGGATCAACAAAATGTT

```
GTCAGAGTATTATATATCCATCAAAACGTTCCTGGTGTGTTGAAAACTGTCAACAATATCTTATCCAAT
CATAACATTGAGAAACAATTCTCCGATTCTCAAGGTGATATTGCTTACTTAATGGCCGATATTTCTGAT
GTTGATATCAGCGATATACAGTCATTATATGAACAATTAGAACAAACTCCATATAAAATTGCTACTCGT
TTGTTGTATTAA
```

YIL074C_homolog 463aa(SEQ ID NO 438)
```
MSSPQQIVNSFQQALNLSGSPNAVSTSPTQSFLSQYVPSKPAKALKPFKTGDIKILLLENVNQTAINIF
KNQGYQVEFYKSSLPEDELLEKIKDVHAIGIRSKTKLTEKILKAAKNLVVIGCFCIGTNQVDLEFAAKS
GIAVFNSPFSNSRSVAELVIAEIITLARQLGDRSIELHTGTWNKVSAKCWEIRGKTLGIVGYGHIGSQL
SVLAEAMGMNVIYYDVMTIMSLGNSKQVESLDELLKKADFVTLHVPATPETKNLLSAPQFAAMKDGAYV
INASRGTVVDIPALVQAMKAGKIAGAALDVYPHEPAKNGEGLFSDSLNEWASELCSLRNVILTPHIGGS
TEEAQSAIGIEVGNSLTKYINEGASQGAVNFPEVSLRPLDLDQQNVVRVLYIHQNVPGVLKTVNNILSN
HNIEKQFSDSQGDIAYLMADISDVDISDIQSLYEQLEQTPYKIATRLLY
```

YIR037W_homolog 486bp public: 1..486(SEQ ID NO 439)
```
ATGTCTCAATTTTACGAATTAGCTCCAAAAGACGCCAAAGGTGAACCATATCCATTTGAACAATTGAAA
GGGAAAGTTGTCCTTATCGTCAATGTTGCTTCCAAATGTGGATTCACTCCTCAATACAAGGGTTTAGAA
GAATTGAATAAGAAATTTGCTGATCAACCAGTACAAATCTTGGGTTTCCCATGTAATCAATTTGGCCAC
CAAGAACCAGGTAGTAACGAAGAAATTGGATCATTCTGTTCATTGAACTACGGTGTTACATTCCCAGTC
TTGGATAAAATTGAAGTCAATGGTGACAATACCGATCCAGTTTATAAATATTTGAAATCACAAAAGAGT
GGTGTTTTGGGATTGACCAGAATTAAATGGAATTTTGAAAAATTCTTGATTGACCAAAATGGTAAAGTT
ATTGAAAGATTCAGTTCATTGACTAGTCCAGAAAGTATCGGTACCAAGATTGAAGAATTGTTGAAGAAA
TAA
```

YIR037W_homolog 161aa(SEQ ID NO 440)
```
MSQFYELAPKDAKGEPYPFEQLKGKVVLIVNVASKCGFTPQYKGLEELNKKFADQPVQILGFPCNQFGH
QEPGSNEEIGSFCSLNYGVTFPVLDKIEVNGDNTDPVYKYLKSQKSGVLGLTRIKWNFEKFLIDQNGKV
IERFSSLTSPESIGTKIEELLKK
```

YJR096W_homolog 849bp public: 1..849(SEQ ID NO 441)
```
ATGTCATATCGATTAATCAAACTCAATTCCGGTCATACCATTCCATCAATTGGATTAGGATGTTATGAT
ATCCCAAGAAATAAAACGGTTTCGGTAGTTTATGAAGCTTGTAAAGTTGGATATCGTCATTTTGATACT
GCAGTGTTATATGGAAACGAAGAAGAAGTCATTGAAGGTATAAGTAAATTCTTACGAGAGAACCCCAAT
ATACCACGATCTGAGTTTTTTTACACCACAAAGCTTTGGAATAATCAATTGGGTACTTCAAGCACTAAA
CAAGCCATTTCAACAATGATGGCTCAAGTTGGTGATAAATTAGAATATATTGATTTATTATTGATTCAT
TCTCCATTACCAGGTAAGACCAAACGTTTAGAAAGCTGGAAAGTTTTGCAGGATGCTGTGGAAAAAGGA
TGGATTAAAAACATTGGGGTTTCTAATTATGGTAAACATCATATTGAAGAATTGTTGACCAATGCAACG
ATCCCTCCAGCTGTCAATCAAATTGAAATTAGTCCTTGGTGTATGAGACAGGATTTAGCTACTTGGTGT
TTAAGTAAAGGTATCAATGTTGAGGCATATGCACCATTAACCCATGGTAACAAATTACAAGTCAACAAT
ACTGAATTTCAAGAAATTATGCAAAAGTATAATAAATCAGCTGCTCAAATATTGATTAAATGGTCATTA
CAAAAAGGTTATATACCATTACCAAAAACAAAAACTCCATCTCGATTAAAGGAAAATCTTTCTGTTGAT
GATTTTGAATTGACTAATGAAGAAATTAAGGCTATTGATCAACCTGATGCTTATGAACCAACAGATTGG
GAATGTACTGATGCTCCATAG
```

YJR096W_homolog 282aa(SEQ ID NO 442)
```
MSYRLIKLNSGHTIPSIGLGCYDIPRNKTVSVVYEACKVGYRHFDTAVLYGNEEEVIEGISKFLRENPN
IPRSEFFYTTKLWNNQLGTSSTKQAISTMMAQVGDKLEYIDLLLIHSPLPGKTKRLESWKVLQDAVEKG
WIKNIGVSNYGKHHIEELLTNATIPPAVNQIEISPWCMRQDLATWCLSKGINVEAYAPLTHGNKLQVNN
TEFQEIMQKYNKSAAQILIKWSLQKGYIPLPKTKTPSRLKENLSVDDFELTNEEIKAIDQPDAYEPTDW
ECTDAP
```

YKL196C_homolog 603bp public: 1..603(SEQ ID NO 443)
```
ATGAAGATTTATTACATTGGTATTTTAAGATCAAGTGGAGACAAGGCTTTAGAGTTAACTTCAGCCAGA
GATTTATCACAGTTTTCCTTTTTCGAAAGAAATGGGGTATCCCAATTCATGACTTTTTTCGCAGAAACC
GTATCCCAAAGAACTCAACCTGGACAGAGACAAAGTGTTGAAGAAGGTAATTATATTGGTCATACTTAT
ACCAGATCAGAAGGAATTTCTGGTATCATTATAACGGACAAAGATTACCCTGTAAGACCAGCATATACA
TTAATAAATAAAATCTTGGAAGAATATTTATCATTGCATCCTAAATCTGATTGGGAAAACATTGATAAA
GCAAATGAAACTTTACAATATGGACAATTAGAAGCATATTTGAAAAAATATCAAGATCCCACTCAAGCT
GATTCAATCATGAAAGTTCAACAAGAATTAGATGATACTAAGGTTGTTTTACACAAAACTATTGAAGGG
GTTTTACAAGAGGAGAGAAATTAGATTCATTGGTTGACAAATCAGAAGCATTGTCAAGTTCTTCAAGA
ATGTTTTATAAACAAGCAAAGAAAACCAATTCTTGTTGTGTGATTATGTGA
```

YKL196C_homolog 200aa(SEQ ID NO 444)
MKIYYIGILRSSGDKALELTSARDLSQFSFFERNGVSQFMTFFAETVSQRTQPGQRQSVEEGNYIGHTY
TRSEGISGIIITDKDYPVRPAYTLINKILEEYLSLHPKSDWENIDKANETLQYGQLEAYLKKYQDPTQA
DSIMKVQQELDDTKVVLHKTIEGVLQRGEKLDSLVDKSEALSSSSRMFYKQAKKTNSCCVIM YKR076W_homolog 771bp public: 1..771(SEQ ID NO 445)
ATGGATGACAAAGGGTGGAGATTTCCTACAAAGGAAGAATTGAAGACATTAAAAACTGAAGACGACATT
TCATTAGGTACACCTGACCATAACTATGATTTTTCCCGTCTTAGAGAATTGTACTTTAAGGCTGAACCA
GAATACGAGGGAAGATTCACAGTTCCAGTATTGTGGGACAAAAAAGAAGGTACAATCGTAAACAATGAA
TCTGCTGAAATCATCAGAATGTTGAATACTGAATTCAATAGTATTTTGCCAAGTGAATATGCCGAAGTT
GATCTTGTTCCAAAAGACTTAGAATCTCAGATTGATGAATTGAACAGCTGGATTTACGATAATATTAAC
AATGGTGTTTATAAAGCTGGATTTGCATCCAAGCAAGAGGTGTACGCCAAAGAATGTCAAAATGTGTTT
GATCATTTGGACAAAGTGGAAGCCATTTTGGAGAAAAACCACAATGGGTCCAAGAAGGGAGAATTTTTG
TTGGGCAACCAATTGACTGAAGCAGATATCAGATTGTACACAACAATTATTAGATTTGATCCTGTCTAC
GTTCAACACTTTAAGTGTAATATTGGTACAATCAGAACTCACTATCCATACATCCACAATTGGCTCAGA
TTATTGTATTGGAAGATTCCTGGTTTCCAAGAAACTACCAATTTCGAGCACATCAAGTACCACTACACC
AAATCTCATATCAAGATTAATCCATACGGTATAACACCATTGGGTCCAGTACCAAATATTTTACCATTG
GAAGAAAAGTAA YKR076W_homolog 256aa(SEQ ID NO 446)
MDDKGWRFPTKEELKTLKTEDDISLGTPDHNYDFSRLRELYFKAEPEYEGRFTVPVLWDKKEGTIVNNE
SAEIIRMLNTEFNSILPSEYAEVDLVPKDLESQIDELNSWIYDNINNGVYKAGFASKQEVYAKECQNVF
DHLDKVEAILEKNHNGSKKGEFLLGNQLTEADIRLYTTIIRFDPVYVQHFKCNIGTIRTHYPYIHNWLR
LLYWKIPGFQETTNFEHIKYHYTKSHIKINPYGITPLGPVPNILPLEEK YKR092C_homolog 1287bp public: 1..1287(SEQ ID NO 447)
ATGGGTGAGTGTGGCTGGGGAGAGGGAATATTTAGCAGCCAGAGGAAAAAGAGACCAAGATTCGTTTTT
GGGCTCATCTCTCTCTCTCTCTTACTCACACAAAAGAAGAGCTACGATTAAAGTTTGCCCAAATGGG
TTGGAAAAAAATTTTTTTTTTAATTTCTTTTTTTCACCTCTTAAAGAGTCAATTATTACAACTACTACCA
ATAGCAAAGATGAGTTCCAATACTCAAGATTTAGTTTTAGCTTATATTAATGATTATGTTTCCAGAAAT
GAAGAATTGTCAAAGTTGAAGAAGGCATTATCGAAATTCTTAGCAGGCAAAGAATTACCAAAAGTTTCT
AAACAGTTGGAATCCATTATTGATGAAGTGGAAAATCAAGAAAAGAAAAGCAAACCAAGAAACTCATCA
TCTGATAGTGAAGACTCTTCATCTGAGAGTGAAAGCTCCACTTCGGACAGCGAAAGCTCCTCCTCAGAT
AGCGACAGCTCTTCCTCAGACAGTGAAAGTTCTTCCTCAGACAGTGAAAGTTCTTCATCAGACAGTGAA
GACAGCGATGACGAGGAAGACAAGGAAGACAAGGAAGCAGAAAAAGATAACAAAGACAGCGAAGACAGC
GAAAACGAAAAAGTGGAAGAAGACAACAAAGACACCAGCTCTGATTCAAGTTCCAGTTCCGACTCAAAA
TCTGATTCAGACTCAGACTCAAGCTCCAGCTCTGATTCAAGTTCTGACTCTGATTCAAGTTCTGATTCC
GACTCCAGCTCCAGCTCTGATTCCGACTCCAGCTCCAGCTCTGATTCCGATTCAGACTCAGATTCTGAT
AGTGACAGTGACGACAATTCCTCAGAAAAGTAGTTCTGAAGACGAAGAATCATCTAGTGATTCAGAATCC
AAAGAGGAACAAAAACAACCAGAAGACAAGAAAAGAAAGCACACAGATGATATCAAAGAAGAAAACCA
GTTAAAAAGTTCAAAAACGAGTCAGAATCATCAGCATCATCTTCTACTGATTCAATTCCTGCAACTCCA
GAACCAGAATTAAAGCCAGGCCAAAGAAAACATTTTTCTAGAATAGATAGAAGTAAAGTTAACTTTGAA
AATTCAGTATTACAAGACAATACTTACAAGGGAGCTGCAGGAACTTGGGGAGAAAAGGCTAGTGAAAAA
TTATTACAAGTCAGAGGTAAAGATTTCACAAAGAATAAAAATAAAATGAAGAGAGGAAGTTATAAAGGA
GGTAGTATCACTTTAGCTAGTGGGTCCTATAAATTCGAAGATTAG YKR092C_homolog 428aa(SEQ ID NO 448)
MGECGWGEGIFSSQRKKRPRFVFGLISLSLSYSHKRRATIKVCPNGLEKNFFFNFFFHLLKSQLLQLLP
IAKMSSNTQDLVLAYINDYVSRNEELSKLKKALSKFLAGKELPKVSKQLESIIDEVENQEKKSKPRNSS
SDSEDSSSESESSTSDSESSSSDSDSSSDSESSSSDSESSSSDSEDSDDEEDKEDKEAEKDNKDSEDS
ENEKVEEDNKDTSSDSSSSSDSKSDSDSDSSSSDSSSDSDSSSDSDSSSSSDSDSSSSSDSDSDSDSD
SDSDDNSSESSSEDEESSSDSESKEEQKQPEDKKRKHTDDIKEEKPVKKFKNESESSSASSSTDSIPATP
EPELKPGQRKHFSRIDRSKVNFENSVLQDNTYKGAAGTWGEKASEKLLQVRGKDFTKNKNKMKRGSYKG
GSITLASGSYKFED YLR043C_homolog 312bp public: 1..312(SEQ ID NO 449)
ATGGTTCACGTTGTCACTGAAGTTAACGAATTCCAAACCCTTTTAAAGGAAACAACTTAGTTATTGTT
GACTTTTTTGCCACTTGGTGTGGTCCATGTAAAATGATTGCTCCATTATTAGAAAAATTCCAAAATGAA
TATTCTAATATTAAATTTTTGAAAATTGATGTTGATCAATTGGGTTCTTTAGCACAAGAATATAATGTT
AGTTCTATGCCAACTTTGATTTTATTCAAAAATGGTGAAGAAGTCAATCGTGTCATTGGTGCTAACCCA
GCTGCTATTAAACAAGCTTTGGCTTCTCTTGCTTAA YLR043C_homolog 103aa(SEQ ID NO 450)
MVHVVTEVNEFQTLLKENNLVIVDFFATWCGPCKMIAPLLEKFQNEYSNIKFLKIDVDQLGSLAQEYNV
SSMPTLILFKNGEEVNRVIGANPAAIKQALASLA YMR273C_homolog 4938bp public: 1..4938(SEQ ID NO 451)
ATGTCACTGCCTAACACGTCATTCCATAGCGATTCAAATTTTGAATCAGCTGTACAAGATCTTGAACAA
GAGAAGAAAATGGTGGCAGCCTTAAAGAGACTATCTATAGGTCATATGATGCAATATGATCCCGACTTG
CCACCAGGCAGTATGGATGATATTGATCCCTTTGCAAACAATAACAACAACAGCAATACCGCTAGTAAC
AATAACCACTATAATGGTCATACCAGAGATCACACCAGCAACAACAACAATACACACAATCATTCTCCC
AACTCAAAATTGAACCACCATCGTGGTCAAAGTCCTTATGATGAAGATTTAATTCCACAGAATATCCAC
AGATCACACTCAACTCGATCACGATCAAAATCACATTCAACTTCTCCTTCTACTTCGCCTCAACACAAG
CAACAACAACAACAACAACCGCAACCTTTTCCACATGAACCACAGACTCCTCCATATAACAAATCACCA
AGCCCAGTCAAGAGACGTAGTTTTTACGACAATTCCAGCGTGTTGACGTCAGAAAGTCACGATATTTTT
TTCGATGCCGAGGATGAAGTTTATGATAGTTCATCCCCTTTGTTGTGGGTACCAGCTAACTCTCATCCT
CAAGTGAATCCTGAATCGTTCAAGAGTTTAATCAAAACTCAAGTGGAAGAGATATTGGAAAGAAAGCTA
TCTCGAAAGTCAACTATTTCAAGAAAGTCAACTTTATCACGCAGCTCCTCAACCAGTACCAAAGAGACA
TTAGCCCCAGAACCAGAAATAAGTCCAGAACTGGAATGTGATGTGTCACCTCCTTCTCCAGTAAGAAAA
TCTTCCTTGTCTTCGTCGTCACAACAAAATCAAAATGAAGACGTTTCTCGAAAATCGTCGTCCTCGGTT
TCTTCAACTTCTCCACAAAAAGATCCAGCTAAGAGAGAATCTTGGTACTTCAACAACTCAAAAAGATAC
CTGAATCCATCATTGCGAGAGCTAACTTCAGAATTGGAGCAGTTGTCAAAAATGGCGGGGATGGACAAG
AATGACGCAGTAACTTTGGCAAGAACTTTGTCGGCACAATCATTGGGGTATACAGATGTGGAAAAATTA
GCATTTGACGAATTAGATAGTTCACAAACAACCGCTACTGCAACAACACCCAATTCACTGGGTTCTCCA
GGAAGTTATGACTCTGCAAACCCACCTCGCACCACGACCTTGCATTTACAACAACGATTACAACATCAA
TTTCAACAAGCTCAAATCAAGGCAGAAAGGGAGGCAGAAAGATCGACAAGACATCAACAAAGCGAACAA
CAGTGGCCAGTATCGAATGACGATAGTCACAAATCTCTGTCACAGTTGACAGCAAGTGAGGGAGGTTCT
ACTGCTAATGCTTTTACCAGTGCTGGGAGTGGTGCTGACTTTGCCTTGAAACGAAGTAGAAGAACTGAT
TACCGGAAAAAGGAAACAGATTCGAAACAAAAGACTTCGAATAATTCGCCTCCTACAAGAAAGTACAAT
GTCCGGAATTCCCAGTTGTTATTTAACTACAAGAAACCAGTAGATTCTCCTTCGCTGTCACCTTCACCT
TCACCATCTACATCTCAAAGCATGATGGGTCACAGGGTGAAACACAAGAAATCTCAAAAGCCATTGGAA
GCAGCATTGGCTAACCCAATGATGGATGGTTCAGATATGTCACATAACCCGTATCCCACTGCTTCAACC
ACTATTGATTTCAGTCCGTATGGGTGCTAAGAAATCAGCCAGACAATCACTTAGTCCAGAGAATGCAATG
GATGGCAGATCTCGAACAAAGCCCGAAAACAAGACTCATCGTGGCTATCTGCATCAAGAAAGGTCTCAT
CCTTATCATCAACAACCACAGCCTCAAGTGCAACCTCAAACCCGCCAACAACTTCCACCAGCACAACAA
GCTCATAGACAATCGACGAGACAAACCCACAATCATCCGAGCACAGGAGTTGAAAAGCATCACCGACAG
GATAACAAGCGTGTAATGCTGTCAGCTTCTAATACAGACATAAATGATTTTATGGCTCAACTGAATCAA
TTTCAGACTAATGGAACAAGAAACCATCGATATGACAACCTCCATAAAAAGGATAAGACTGCATTTTTG
CCAAATGAAGACCACCAACGTAAGTCCCATTCGACAAGAAATTCAAATGTAAGAAATTTGTCTTCCTCG
TCTCAACAGCATTTACATCAACCGTATCTGACAACTTCTGTTGCGCCCAAGTCACGTCAACTACATCAA
AATTTAGACAAGTTGAGATCCGAGATCAATGAATTTAAGGAAAGCTTGAATAAATCGGAATTACCTGGT
GAGGAATCAAAAAGAGAACACAGACTGCGTCACGACCAGCACCACCAACAACGACAACGACCAGCACCA
TCACAGCACCAACTTGAGCCTCGCAATTACAACCACAATGACCGTCACCAAAGACAACAGCATGAACAT
GTACAACCCCAACAAGTCCAGCCCTTACAGTCAGATCATAGTTTTTGATATCAGTTATCAAGATTTAAGC
GTTGAAGATCAATTGGGTATTGAACAGGAAGCATTGAGAGAATTAGGCAAGGAAAAGGGGGCATTCTCAT
GAGATTGATATAGATGATGCATTTGATGAAAATTTAAAANTTCTGCCTATCAATGAACGACATGGCTCT
CAATTCACACTTGATCATGACATTTTGGACAGCTTTAATTTGGTAGATAATCAGTTGGTTGGATCTGCA
GATGAAGGAATTGATAATTTGAAGGGTAAGAATGAAATACCCGTTGGGCGACAACAACCACAACAACAA
CGTCAACAACCAAGAGCTGCTTCGCCACCATCCTCACAGCAGTACTTGGGGCATGATGAATTGCACTTG
CAACAAGGTAAAGATACAAATAAAAAGTTGGTCCTCGTTTAAGTATTGATACATTGCAGAACAAGCCT
ATTCACCCTGAGGAAACTGCAACTGGATTTGGAATGCGTTACCTTCCCCTACGTTGCATTTAGAT
GAATCTCAAAATAGCACTCCTGGACATCTGAGAAAGGCAAGCAATTCTGCAAGCTACGACGATTACTAT
AATATAGCCGACAAATCATCTACTGCGGGTACCCCCAAAACAAAGAAGGAGACCAAAGTTAAAACGAAA
TTATTCAATAAAGACCCTAATTTGGAGATTATAGACTCTGATAACTATAAGGAAAAAATGGGCATTGAG
ACATCTAACAATAAAAAATTGAAAAGAAGAAATCTTTTGGTTTGCTTAGTACAACATCATCTGTGGGA
GCAAATGATACATCTGAAAATGAAGGGCCCAAGAAATTGAAAAAGAAAAAGTCGTGGGCTGGTTGCGG
GAGCGTTCTGCCAGTGCCTCGTCTGCAGATATCAACAATTTGCCGCCTTTGCCTCTTGATAAACTACCT
ACAAGATCATTCTCAAATCCCGAAACGTCAACTGACCAACACCAGAAACATGATCTTGAGAACGGTTCA
GATCTTGAACGTGAATTGGAACACGAACCTGAACTTGAACTTGAGTTGGAGCTGGATCTTGAGTTTGAT
TACGAGCAACAAAGAAAGCACCAAGATGCTTCAATGGTAAATGATTCAAGCTTTGCAGTTGATTCTATC
TCTATGAAGTCGACAGACAAGGAAAACGTGCTTTCCAAATTTTTCAAGAAAAAGGCAAAGGTACCAGGT
TCAAGCTCACAGTCAGTATTTTCATTTGAATCAAAAGGTTCAGGGGCCAGCGTCGACTATGAATCGGAC
AACGACGCGAAACTGATCAAAAAGAAGGGCAACAATAGCAGCAGGTTATTCAAGAAGAAATCAAGGGCC
AAATTGTCAGAACAAGAGAATTCAGTGAATAAGGAAAAGCTTCGACCCTTTGAATTTAGTGTCAAACGAA
TCGCAGACGATCGAGGAGAAAGAGAATTTGCGACAAAGTAATGGCACTCGTAAGGCAGAAAGAGTTGAG

```
AGTCAAGAGCAACAGGAGGAACAGTTCCCTGTAACCTCGTCGCCGATACATCAATTCAACATTGAACAT
CTCAAAGACGACTTTGTCACTCTTGGGGAGAAGGACGATGTTTTAGATTCTGGTACTGATGACTTGGTT
GAAGATGTAAGATCTCGTAACATTCAGAGCACAATAGTTATTGTTGATGAGGATGAAACTCCTATTCAA
AATAACAATGATAACAAAGATTTGGGGATGCTAAAAGTTGACGAATTGTCCAAAAAGAAATCAATTAGC
AGGAAAAAACGGAACAATATGCAAAAGAAGAACCTTTCTACTGAACTTACTGATACAAACAAAGAGGTA
GTAGAGGAGGTTCTTGCAACTGAGCAAAGTGTCAAACCAAGCCAAGGGGAAGATCTTTTGTCTAAGAAT
GAAGATAAAGAGAAATTAGATATCCAAGAAAAGTTGAAGAAATCAATAAAACGTACATCAAGGGCCAAC
CAGCCTATTGAGTTTACTGATTCAGCCTTTGGGTTCCCCTTGCCACCACCATCTCAATCAACTTTAGTG
ATGCTTGACTACAGATTTCCAGTTCATGTTGAGCGTGCCATTTATAGATTGTCACACTTGAAACTTGCT
AACCCTAAGCGTTCACTAAGAGAGCAAGTTTTGTTGTCGAATTTTATGTATGCCTACCTCAACTTAGTT
GATCATACATTACATTTAGAGCAACAAAATATGAGCAGTGAGGATGGCGATCAGATGGAACGTGACGAC
GACGAAGAAGAAGAAATGACTGACACTGATGAGAAAGACATGATTTTTGGAGAGAGTAATATTGCCGAT
GACGATGATCTTATTCCTGAAGAAGCAAATGGTGATTCGATTGGGATTAACTTAGATATGGATGGTTTA
CATAGGAAACAGCATCATCAATCTGGAATCGAAGTATAG

YMR273C_homolog 1645aa(SEQ ID NO 452)
MSSPNTSFHSDSNFESAVQDLEQEKKMVAALKRLSIGHMMQYDPDLPPGSMDDIDPFANNNNNSNTASN
NNHYNGHTRDHTSNNNNTHNHSPNSKLNHHRGQSPYDEDLIPQNIHRSHSTRSRSKSHSTSPSTSPQHK
QQQQQQPQPFPHEPQTPPYNKSPSPVKRRSFYDNSSVLTSESHDIFFDAEDEVYDSSSPLLWVPANSHP
QVNPESFKSLIKTQVEEILERKLSRKSTISRKSTLSRSSSTSTKETLAPEPEISPESECDVSPPSPVRK
SSLSSSSQQNQNEDVSRKSSSSVSSTSPQKDPAKRESWYFNNSKRYSNPSLRELTSELEQLSKMAGMDK
NDAVTLARTLSAQSLGYTDVEKLAFDELDSSQTTATATTPNSSGSPGSYDSANPPRTTTLHLQQRLQHQ
FQQAQIKAEREAERSTRHQQSEQQWPVSNDDSHKSSSQLTASEGGSTANAFTSAGSGADFALKRSRRTD
YRKKETDSKQKTSNNSPPTRKYNVRNSQLLFNYKKPVDSPSSSPSPSPSTSQSMMGHRVKHKKSQKPLE
AALANPMMDGSDMSHNPYPTASTTIDFSRMGAKKSARQSLSPENAMDGRSRTKPENKTHRGYSHQERSH
PYHQQPQPQVQPQTRQQLPPAQQAHRQSTRQTHNHPSTGVEKHHRQDNKRVMSSASNTDINDFMAQSNQ
FQTNGTRNHRYDNLHKKDKTAFLPNEDHQRKSHSTRNSNVRNLSSSSQQHLHQPYSTTSVAPKSRQLHQ
NLDKLRSEINEFKESLNKSELPGEESKREHRSRHDQHHQQRQRPAPSQHQLEPRNYNHNDRHQRQQHEH
VQPQQVQPLQSDTSFDISYQDLSVEDQLGIEQEALRELGKEKGHSHEIDIDDAFDENLKXSPINERHGS
QFTLDHDILDSFNLVDNQLVGSADEGIDNLKGKNEIPVGRQQPQQQRQQPRAASPPSSQQYLGHDELHL
QQGKDTNKKVGPRLSIDTLQNKPIHPEETATGFGMNALPSPTLHLDESQNSTPGHSRKASNSASYDDYY
NIADKSSTAGTPKTKKETKVKTKLFNKDPNLEIIDSDNYKEKMGIETSNNKKLKKKKSFGLLSTTSSVG
ANDTSENEGPKKLKKKKSWGWLRERSASASSADINNLPPLPLDKLPTRSFSNPETSTDQHQKHDLENGS
DLERELEHEPELELELESDLEFDYEQQRKHQDASMVNDSSFAVDSISMKSTDKENVLSKFFKKKAKVPG
SSSQSVFSFESKGSGASVDYESDNDAKSIKKKGNNSSRLFKKKSRAKLSEQENSVNKEKLRPLNLVSNE
SQTIEEKENLRQSNGTRKAERVESQEQQEEQFPVTSSPIHQFNIEHLKDDFVTLGEKDDVLDSGTDDLV
EDVRSRNIQSTIVIVDEDETPIQNNNDNKDLGMLKVDELSKKKSISRKKRNNMQKKNLSTELTDTNKEV
VEEVLATEQSVKPSQGEDLLSKNEDKEKLDIQEKLKKSIKRTSRANQPIEFTDSAFGFPLPPPSQSTLV
MLDYRFPVHVERAIYRLSHLKLANPKRSLREQVLLSNFMYAYLNLVDHTLHLEQQNMSSEDGDQMERDD
DEEEEMTDTDEKDMIFGESNIADDDDLIPEEANGDSIGINLDMDGLHRKQHHQSGIEV YNL112W_homolog 1332bp public: 1..1332(SEQ ID NO 453)
ATGTCATACAATAACGGAGGATATAATAATAGAAACGGAGGTAGTTACGGTGGAGGCTACGGCGGTGGT
GGTAGCAGAGGTGGAAGAGATGGCTACAGTGGTGGTGGCAGAGGCGGTGGCTACGGTGGTGGTGATAGA
GATCAAGGTGGATACAGAGGTGGAAGATTCAGTGGTGGTGGCCGTGGTGGTGGTAGATTTAATGATGCT
CCAAGACAAGAATTAACTGCTCCACAATGGGATTTAGAACAATTGCCAAAATTTGAAAAAAATTTCTAT
TCAGAACATCCAGATGTTGCTGCCAGATCTGATAGAGACATTGAACAATTTAGAAAAGAAAATGAAATG
ACAGTTAAAGGTCATGATATCCCTCATCCAATCACCACTTTTGATGAAGCTGGGTTTCCCAGATTATGTT
TTACAAGAAGTCAAAGATCAAGGTTTCCCTAAACCAACTCCTATTCAGTGTCAAGGTTGGCCTATGGCT
TTGAGTGGTAGGGATATGATTGGTATTGCCGCCACTGGTTCCGGTAAAACTTTATCTTATTGTTTACCA
TCTATTGTCCATATTAATGCTCAACCACAATTACAATATGGTGATGGTCCAATTGTTTTGGTTTTAGCA
CCAACAAGAGAATTGGCAGTGCAAATTCAAACTGAATGTTCCAAATTTGGTAAATCATCAAGAATTAGA
AACACTTGTGTTTATGGTGGTGCACCAAAAGGTCCTCAAATTAGAGATTTAGCCAGAGGGGTTGAAATT
TGTATTGCCACTCCAGGGAGATTAATTGATATGTTGGAAGCTGGTAAAACTAATTTGAAAAGAGTCACT
TATTTGGTTTTAGATGAAGCTGATAGAATGTTAGATATGGGTTTTGAACCACAAATTAGAAAAATTGTT
GATCAAATTAGACCTGATCGTCAAACTTTGATGTGGTCTGCTACTTGGCCAAAAGAAGTGCAACAATTG
ACTAGAGATTATTTGAACGATCCTATTCAAGTCACCATTGGTTCATTGGAATTGGCTGCTTCTATACT
ATTACTCAATTGGTTGAAGTCATTGATGAATTTTCCAAGAGAGATAGATTAGTAAAACATTTGGAATCC
GCTTTAAATGAAAAGATAACAAAATATTGGTTTTTGCTTCTACTAAAAGAACTTGTGATGAAATCACC
ACTTATTTAAGATCAGATGGTTGGCCAGCATTAGCCATTCATGGTGATAAAGAGCAAATGAAAGACAT
TGGGTTTTAGATGAATTCAGAAAGGGTAAAACTTCTATTATGGTTGCAACTGACGTTGCTGCTAGAGGT
ATTGGTATGTATAATTTTTAA
```

YNL112W_homolog 443aa(SEQ ID NO 454)
MSYNNGGYNNRNGGSYGGGYGGGGSRGGGRDGYSGGGRGGGYGGGDRDQGGYRGGRFSGGGRGGGRFNDA
PRQELTAPQWDLEQLPKFEKNFYSEHPDVAARSDRDIEQFRKENEMTVKGHDIPHPITTFDEAGFPDYV
LQEVKDQGFPKPTPIQCQGWPMALSGRDMIGIAATGSGKTLSYCLPSIVHINAQPQLQYGDGPIVLVLA
PTRELAVQIQTECSKFGKSSRIRNTCVYGGAPKGPQIRDLARGVEICIATPGRLIDMLEAGKTNLKRVT
YLVLDEADRMLDMGFEPQIRKIVDQIRPDRQTLMWSATWPKEVQQLTRDYLNDPIQVTIGSLELAASHT
ITQLVEVIDEFSKRDRLVKHLESALNEKDNKILVFASTKRTCDEITTYLRSDGWPALAIHGDKEQNERD
WVLDEFRKGKTSIMVATDVAARGIGMYNF YOL151W_homolog 1032bp public: 1..1032(SEQ ID NO 455)
ATGTCAACACCAATTACTGTTATTGTTTCTGGAGCCACAGGATTTATTGCTCAACACGTTGTTAAACAA
TTATTAGCTAAAAACTATCAAGTCATTGGTACAGTTAGATCAACAGCCAAAGGTGATCATTTATTAAAA
TTATTCAACAATCCACAAAACTTATCTTATGAAATTGTTGAAGATGTTGGAACTAAAGGTGCCTTTGAT
AAAGTATTACAAAAACATGGAGAAGCAAAAGTGTTCTTACATTTAGCTTCACCATTCCATTTTAATGTG
ACTGATGTTGAAAAGAATTGTTATTGCCTGCTGTTGATGGTACTAAAAATGTATTACAAGCAATTTAT
AATTTTGGTAACAATATTGAAAAGTGGTTATCACTTCATCTTATGCTGCCATTAGTACCGCTTCTAAA
GAAGCTGATAAAAATGCAATTATTACAGAAAAGGATTGGAATGAAATCAGTTGGCAAGATGCTTTACTT
AATCCAGTTAATGGATATCGTGGATCCAAAAAATTTGCTGAAAAAGCTGCTTGGGATTTTATAAAATCT
AATGATAATGTTAAATTTTCATTGTCGACAATTAATCCATCATTTGTATTTGGTCCACAATCATTTGGT
TCAGAAATTAAACAAGTTTAAACACTTCTAGTGAAATCATTAATTCTATTTTGAAATTGAAACCAAAT
GATTCAATTCCTGCGTCAAAAGGAGGTTGGGTTGATGTAAGAGATGTTGCCAAAGCTCATATCATTGCC
TTTGAAAATGAGGATGCCAAAAATCAAAGAATATTGTTGAATTCAGGTAGATTTACATCTCAATCACTT
GTTGATATTATTAATGATAAATTTCCAGATTTGAAAGGGAAAATACCAGTTGATGAACCAGGTTCAGAT
AAATCTGTTATTGCTGAAAGTTTGGCTACTATTGATGATACCAAATCTCGTGAATTATTAGGATTTGAA
TATTATAACCTTGAACAATCAGTTTATGATACTGTTGAACAAATTGTTAATGCTCATAAGTTGTAA YOL151W_homolog 343aa(SEQ ID NO 456)
MSTPITVIVSGATGFIAQHVVKQLLAKNYQVIGTVRSTAKGDHLLKLFNNPQNLSYEIVEDVGTKGAFD
KVLQKHGEAKVFLHLASPFHFNVTDVEKELLLPAVDGTKNVLQAIYNFGNNIEKVVITSSYAAISTASK
EADKNAIITEKDWNEISWQDALLNPVNGYRGSKKFAEKAAWDFIKSNDNVKFSLSTINPSFVFGPQSFG
SEIKQSLNTSSEIINSILKLKPNDSIPASKGGWVDVRDVAKAHIIAFENEDAKNQRILLNSGRFTSQSL
VDIINDKFPDLKGKIPVDEPGSDKSVIAESLATIDDTKSRELLGFEYYNLEQSVYDTVEQIVNAHKL YOR286W_homolog 546bp public: 1..546(SEQ ID NO 457)
ATGTTTGCATTTAAAAAATCTACTACTTCAATTCTCAAAACAGTGGTCGCCCCAACATCATCTCGTTAT
TTATCCACCGTCACATTAAGATCAATCCCAAGAACATTCCATAATGCCACTAAAGTTTCATTATTCAAT
GGATTAAGAACTACACCAAGATTTTATAGTGTATTGACTGAATCTCCAGAGGCAAAAGTATATAAATAT
GCCGATGTTAAGGATGTGGCCGTACACCCTGAAAACCACCCTGATTCTGTTTTAGTGGATGTTAGAGAA
CCAACTGAATTTGGAGATGGTCATATACCAGGAGCTTTGAATATTCCATTTAAAAGTAGTCCCGGCGCA
TTGGATTTGTCAGAAGAAGATTTCCAAGAACATTTTGGATTTCCTAAACCAAGTACTGATAAAGAATTG
ATTTTCTATTGTCTTGGAGGTGTTAGATCTACTGCAGCTGAAGAATTGGCCAATACTTTTGGTTATAAG
AAAAGAGGAAATTATCTTGGAAGTTGGGAAGATTGGGTAAAACATGAAAATAAAAAGAACTAA YOR286W_homolog 181aa(SEQ ID NO 458)
MFAFKKSTTSILKTVVAPTSSRYLSTVTLRSIPRTFHNATKVSLFNGLRTTPRFYSVLTESPEAKVYKY
ADVKDVAVHPENHPDSVLVDVREPTEFGDGHIPGALNIPFKSSPGALDLSEEDFQEHFGFPKPSTDKEL
IFYCLGGVRSTAAEELANTFGYKKRGNYLGSWEDWVKHENKKN YPL078C_homolog 702bp public: 1..702(SEQ ID NO 459)
ATGTCCATGATCAACAGAATTGCATTGAGAAGTGCTCGCCCAGCCATGGGAATGGCTTTCCGTCCAGCC
CCAATTGGTTTGAGATACTTGTCTGCTCCAGCTGACCCAAAACAAAAGGCCAATTCCATCATTGATGCA
TTACCAGGTAACAACTTATTATCTAAGACTGGTGTTTTGGCTACTTCAGCCGCTGCTGCCATCTATGGT
ATTTCCAATGGATTATTTATTATACACGATGAAACCATTTTGCTTGTCACTTTTGCAAGTTTCACAGCT
TTGGTCGCCAAATTCGTTGCTCCTTTATACACTGAATGGGCCGATGGTGAAATCAAAAAAGTCAACGAT
ATATTGAATCAATCTAGAACTAACCATATCGAAGCCGTTAACAAGAGAATTGAAACCGTTTCAGAATTA
AAAAACGTTGTTGCAACCACTGAAGATTTGTTTGCTTTATCTAAAGAAACCGCTCAATTCGAAGCTGAT
TCATTTGAATTAAAACAAAAATTGGCTGTTTCTCACGAAGCTAAATCTGTTTTGGACTCTTGGGTTAGA
TTTGAACAACAACAAAGACAATTGGAACAAGAACAATTGGCCAAGAAGTCATTGATAAAGTTGACAAA
GAAATTGCTAATCCAAAATTCCAAGACAAAGTATTGGCTGAATCTCTTAACGAAATCGAAAAATTGTTT
GCTAAAAACTAG YPL078C_homolog 233aa(SEQ ID NO 460)
MSMINRIALRSARPAMGMAFRPAPIGLRYLSAPADPKQKANSIIDALPGNNLLSKTGVLATSAAAAIYG
ISNGLFIIHDETILLVTFASFTALVAKFVAPLYTEWADGEIKKVNDILNQSRTNHIEAVNKRIETVSEL
KNVVATTEDLFALSKETAQFEADSFELKQKLAVSHEAKSVLDSWVRFEQQQRQLEQEQLAKEVIDKVDK
EIANPKFQDKVLAESLNEIEKLFAKN YPL085W_homolog 2490bp public: 1..2490(SEQ ID NO 461)
ATGTTGTCCTTAAAGTTGAAACATGCATTGACTTTAGCTGATTATGGATTGATCAATGAATCACAGAGA
TATATTGATCATATTAATTCTAGTATCAAGACATTGGGTAACAAATCACCTTTTGTCACGCCTAATTTG
CTTCATGAGTTTCAGAATTTGATTATGAGAATCACTGAAGTTGGATCTGGAGATGATCAAAACAACTGG
TTTTCCGGTAAGATTAGTCGAGTCAATCTTGATAAGATCTGGGGACAAATTGATAAATTTATTGTTGGT
GGAGATGAACTGAAAAATGGTAACAATAACGATGGTAATGGAACTGGCAATGGAAGTGGTAGTGTTTTC
AATAAATTTAGCCCTTCCGTGTCGAGAAATGCATCAAGTGTGAATTTACACAATTATGTACAACCTTCA
ATGATTAGGCAACCATCACATTTACCATATCAACCACAACAACAACCGCAACCGCAACAGCAATTATTG
GATCAAGTTCACATTGAAAGAAAACCTACAACTGGATTCACTCCGCAACCACCACCATTAGTTGGTCAT
CCATCAACGACATCAGTTAATAAATATTCTCCAAGTATTAAATCGAGTCCTCGTCAAGCACAACTGAAT
AAGTTTGAAAAATATGCCCCAAGCAACAATTCATCTCATCATAATCTTAGTCTTGTTGAAGAAAGGTCA
GCTGTTACTAGTGCTGATGGTCCTGAATACCCTCACCACCAACACCAACAGAGTATCAATGCGTCAACA
GTTCCCGTGCCACTTCCACCACCAACACCACCGGTAAGCATGCCACAACATGTATCTAGGTCTCCACGT
AGCCATCAACTGCACCAACCACCAACATTACCACCACTGCATTCACATCATGTTCAACAACCATCTAGA
GATCGGTCACCATTAGCGACACGAATCTACCCTTATAGCAATAGTGTTGGCGGACAAATTTCTACTACG
TCAGTGGGTTCTATTCCTAGTCAAATACCACTTGGTCGACAGACTCATGGGAAACAACCTTCTATTTCA
AGTGTAATTTCTGGAGATAGTATTGCAGCAGTTGGTTTAGGAGAACAAGAGAATGTTTTACCCCCATCA
ACCGGACAAACAGGGAAAACAGCTACAAGTGAAGTGAATAGAAATGAGGAAGGTTATGGATTTGGGGGT
CACTATCATCATGATCAACCTGAAACTATAACGGAATCTCCAGAATTAAGAGGCTTACAACAACCACAG
TCCAGTGAAGCAGAAATTAGTAAAGACATTTCAAATGATGTAGCATTGGATAGTGCTAAGATACCAGAA
GCTTCACAGGAACCAGAAGGAAGAAACGGACGAATCAGGTAATGTGGCAGCTGCTCCACCACCTCTACCT
GCTCCAGTTGCACCTCCTAGAAAAACAAAATCTTCTAGATCTAATCCATATGCTCCATCTACAGATATT
GGTGCTATCAGTAATGCACCATCAGCAATAGGACAAACACCTAGTGGGAAACCAAGTGTGAGAAAATCA
GGATCAAGAACTAACAGATATGGACCACCACCAGGAGTTGGTAATAAACAACCAACTATTGATGTTTCG
CCACCTTCTGCTACTAATAATACTGGTAATGAAGATTCCATTAGTATGTTTTCCTATGGTGCCTATCAA
AATGAGTCTAGTCCTCCACTCAAGCAACCGTCACAATTTGATCAGACTGCAGTTGCATCTGCCCCTGCT
CCACATCCATTACAACCACAATTGGCGGTTCCAGAAAGAGTTCCAACTAAAAATGTCGCCAATATTGAT
GATAGTTTTGATGAAAATAGTTTAGCAGCTGATACATTAACAACTTACAATAATAATATGGTAAATAAA
CCATATGGACTGTCACCAATGGGACCAACTGTTGCAACTAATGGACCTGGATCAGTTACTCTGACACCT
TTGATTTTAAATCAAGGTTCTGCAAATATGAAATTATCAAATCTCAGTACTATTAGTGTCACTGGAACT
GGAGCCGGAACTGTTACTGGGACTGGTGGAGCATTCGATGGATTTCCTATACCAGGATCACCTGATGAA
ACTACTCGACCAAATTCTATATTTGGTGGTCATACTAGAGGATTATTTTCTTCAAGATTATCAGAATCA
CAAAGTGTATTATATCAACAATATGCAATTGCTGATGATACAGTTGGTGATTATATTCCTATTATGGAA
GAAGATGATGAAGATGATGAAGATGAACAAGCTAAGCAACAGAAACAAAAAGAAAAAGAGGCACAAGAA
CAAGAATTGAAGAGAAAGCAGGAACAACAACAACAAAAAGCTGCAGCAAAGAATAACAACAATAGTGGC
GGTGGTGGTGGCAAATTCTTTAGCTTATTCGGTGGTGGTGGTAATAATAAGAAACAAGATAATGATGCT
AAAGTTTATAAAGCTCATTTAGGACAAAAGAATACTTTTGTTTATGATGAAAAATTGAAACGTTGGATA
GATTAA YPL085W_homolog 829aa(SEQ ID NO 462)
MLSLKLKHALTLADYGLINESQRYIDHINSSIKTLGNKSPFVTPNLLHEFQNLIMRITEVGSGDDQNNW
FSGKISRVNLDKIWGQIDKFIVGGDESKNGNNNDGNGTGNGSGSVFNKFSPSVSRNASSVNLHNYVQPS
MIRQPSHLPYQPQQQPQPQQQLLDQVHIERKPTTGFTPQPPPLVGHPSTTSVNKYSPSIKSSPRQAQSN
KFEKYAPSNNSSHHNLSLVEERSAVTSADGPEYPHHQHQQSINASTVPVPLPPPTPPVSMPQHVSRSPR
SHQSHQPPTLPPSHSHHVQQPSRDRSPLATRIYPYSNSVGGQISTTSVGSIPSQIPLGRQTHGKQPSIS
SVISGDSIAAVGLGEQENVLPPSTGQTGKTATSEVNRNEEGYGFGGHYHHDQPETITESPELRGLQQPQ
SSEAEISKDISNDVALDSAKIPEASQEPEEETDESGNVAAAPPPLPAPVAPPRKTKSSRSNPYAPSTDI
GAISNAPSAIGQTPSGKPSVRKSGSRTNRYGPPPGVGNKQPTIDVSPPSATNNTGNEDSISMFSYGAYQ
NESSPPLKQPSQFDQTAVASAPAPHPLQPQLAVPERVPTKNVANIDDSFDENSLAADTLTTYNNNMVNK
PYGSSPMGPTVATNGPGSVTSTPLILNQGSANMKLSNLSTISVTGTGAGTVTGTGGAFDGFPIPGSPDE
TTRPNSIFGGHTRGLFSSRLSESQSVLYQQYAIADDTVGDYIPIMEEDDEDDEDEQAKQQKQKEKEAQE
QELKRKQEQQQQKAAAKNNNNSGGGGGKFFSLFGGGGNNKKQDNDAKVYKAHLGQKNTFVYDEKLKRWI
D YPL190C_homolog 396bp public: 1..396(SEQ ID NO 463)
ATGCCAAGTACAAAAAGATCATCATCTACTGAATACTCCCATAAAGACTCTAAAAAGAAAGTCAAACTA
GATTATGTAAATCTCAAACCATCACAAACGTTATATGTCAAAAATCTAAATACCAAAATCAATAAGAAA
ATTTTATTGCATAATTTGTACCTATTATTTTCTGCATTTGGAGATATCATTTCTATAAATCTACAGAAT
GGTTTTGCCTTTATAATATTTAGTAATTTAAATCTGGCTACATTGGCGTTGAGAAATTTGAAAAATCAA
GATTTTTTTGACAAACCACTTGTATTAAATTATGCTGTCAAGGAATCTAAAGCTATTTCTCAGGAGAAA
CAAAAACTACAAGATGAAAATGATGAAGAAGTGATGCCACTGTATGAATAA YPL190C_homolog 131aa(SEQ ID NO 464)
MPSTKRSSSTEYSHKDSKKKVKLDYVNLKPSQTLYVKNLNTKINKKILLHNLYLLFSAFGDIISINLQN
GFAFIIFSNLNSATLALRNLKNQDFFDKPLVLNYAVKESKAISQEKQKLQDENDEEVMPSYE YBR112C_homolog 3243bp public: 1..3243(SEQ ID NO 465)
ATGTATGCGACAGCCCATACAATTAAACAACAACAACAACAACAACAACAACATCCACCACCACCTTTA
AACGGTGGACTACATGCAAGTGGGGCTCCTCCAAATTCCCATGAAGCAGCAGCTATTGCTCAGCAACAA
CAACAACAGCAGCAACACCACAATGGTCCTGGTATGATTGTTGCCGCAGCTGCAGCTTCTGCTAACCAA
CAAGCTGTCCAAGCCAGAGCCCAACAACAACAACAGCAGCAACAACAGCGATTACCTAGTTCAGCTGCT
CTTAATGAAACTACAGTATCAACTTGGTTAGCCATTGGTTCATTAGCCGAGAGTTTAGGTGACATTGAA
CGTGCGACAGCTTCTTACAATTCCGCTTTGAGACATTCACCAAATAACCCAGATATTTTAGTCAAAATA
GCAAATACATACCGTTCAAAAGATCAGTTTCTTAAGGCTGCTGAATTGTATGAACAAGCTCTTAATTTC
CATGTTGAGAATGGTGAAACTTGGGGATTATTGGGTCATTGTTACTTGATGTTGGATAATTTGCAAAGA
GCTTATGCTGCTTATCAACGTGCATTGTTTTACTTGGAAAACCCTAACGTTCCAAAATTGTGGCACGGA
ATTGGTATTTTATATGACAGATATGGCTCATTAGAATATGCTGAAGAAGCCTTTGTGAGAGTTTTGGAT
TTGGATCCAAATTTCGACAAGGCTAATGAAATTTATTTCCGTTTAGGGATCATTTATAAGCATCAAGGT
AAACTACAACCAGCATTAGAATGTTTCCAATACATTTTGAATAATCCACCACACCCATTAACTCAACCA
GATGTTTGGTTTCAAATTGGTTCAGTGTATGAACAACAAAGGATTGGAATGGTGCTAAGGATGCTTAT
GAAAAAGTGTTACAGATTAATCCTCATCACGCTAAAGTTTTGCAACAATTGGGATGTCTTTATTCCCAA
GCAGAATCAAATCCATCAACACCAGCTAATGGTGCTGCACCACCACATAAGCCATTCCAACAAGATTTG
ACCATTGCTTTAAAATATTTGAAACAATCTTTGGAAGTTGATCAAAGTGATGCTCATTCATGGTACTAT
TTGGGTAGAGTAGAAATGATTAGAGGTGATTTCACTGCTGCTTATGAAGCTTTCCAACAAGCTGTCAAT
CGAGATGCAAGAAACCCAACTTTCTGGTGTTCAATTGGTGTTTTGTACTATCAAATAAGCCAATATCGT
GATGCATTGGATGCTTATACCAGAGCCATTAGATTAAATCCTTATATCAGTGAAGTATGGTATGATTTG
GGGACTTTGTATGAGACTTGTAATAATCAAATTAGTGATGCATTGGATGCATATAGACAAGCAGAAAGA
TTGGATCCAAATAATCCTCATATAAAGGCAAGATTAGAACAATTGACAAAGTATCAACAAGAAGGTAAT
ACTCACCCACCTCAACCACCGCCAAGTTCTCAACAACCTAGATTACCTCAAGGAATGGTTTTGGAAAGT
ACTCAACAACAACAGCAACAACAACCACCACCACCTCCACAACAACAACAACAACAACTTCAACACCAA
CTGCAACTGCAACCTCAACCACAGCAACCACCTCAAACCCAATCACAACCACTGTTACTTCAACACCAA
TCTTCATTGCCTCCTCAACAAATCCAACCATTACATCAACAAGCTGCAAAGCCCTTTAGTGAATCAACAA
CAAAGTCCACCACCACCTCACTTGATGAACTTGGGACAACCGGGGCAACAACCACAACAATTGCCACCA
CATCTTCCACCACATACCCAGCAACCTTCTCAAATTCAAGAAAAGCCTCCAACTCAAGAACAACCACAT
TATCAACCACCTCCACCTCCACAACATCAACAGCAATCGCAATCGCAACCGCAACCTCCACACCAACCT
CAACACACTCAAAATCAACTGCCTCAATTAGCTCAATTGCCACCACACCATTCTAATCCTCCAGCTAAG
CCACATGGTGCACCTCAACAAAGAACTGGTTTACCGGATTTATTACACAACTCTGCTAATATCATATCA
GCTCCATCACAAGTACCTCAACCACAACAACAATATCAACAACCACATATTGCACCTGTTAGACAAGAA
CAAGTTAACCATGTTCCTTCAATTTATCTGGCTACAAAGGCACCAAATTGAGACAACACTTCCTCAAATCAAC
AACCCAAATGAGTCAACCACAACAAGTTCCACAACTCAAAAAGGAGGAACCTAAACCAGAGGCTACT
GTTTCTGCTCCAGTTCCTGAGGCTATTAAAGTTCAAGATCAAGTGACAATCCAGGAGTCAGCACCAGCA
GCAGCAGCAGCAGTGTCAGCACCAGCTTCTGCTCCAGTTGGTGATATAAAACAGATACTGTATCTACT
ACTACACCTGCTACTTCAACCACTGCAGATGCTGTGCCAGTATCTGTGTCTCAAGTTGGTGAAGCACCA
AATGTTGTTCAAGAGAAGAAAGTTCCGGACACCGAGCAGATCGTTTCACAAGTTGAAAAACCCGTGGAG
TCACAACCAGAAGTTACACCAGCTCCAACACCAGCTCCAGCTCTTGCAACAGCACCAACTGAACCTGCA
CCTACTGATAAGGACGTTGTAATGGCTCCAAGTAAAAGTGCAACACCTGTTCCTCAAAGTATTGTGGAA
CAGAACACCAGAGTATCTGAAGCTACAAAGGCACCAGAATCCAATGGTAAACATGATTTAGAAGACAAG
AATGATGAAGAAAAATTTTAAAGAGGCCAACTGTTGAAACGACTACTGAATCTGTACCAGTTAACCAA
CCTGTTGAGAAAGAAATGAAAAAGTTGAGGTACCACCGCCACTGGAACAACCAAGTTCAGAAAAGAGA
GAAAAGAAGTCAACGGATCAATTAAGAAACCATTGGAAAATGAAAGTAAGGTTGATATTCCTCAATTC
TCATCAAATATCACAGCTCAAAATGAAGAAGCAAAATCTGGAGAAGAAACTAAAAAAGATACAACCAAG
ACAAGTCCAGCAAAACAAGGGGAAGTTAAGGAAGTAATACCATCATCTACAGAAACTGTATCAAAACCA
GATGTTGAAAAAGACAATAAAGAGAAAGACAAAGATGAAGATGAAGTGATGGCTGATGAAGATGACGTC
AAAAAAGATGAAAATCCAGAACCTCCAATGAGAAAGATTGAAGAAGATGAAAATTATGATGATGAATAG YBR112C_homolog 1080aa(SEQ ID NO 466)
MYATAHTIKQQQQQQQQHPPPPLNGGLHASGAPPNSHEAAAIAQQQQQQQQQHHNGPGMIVAAAAASANQ
QAVQARAQQQQQQQQQRLPSSAALNETTVSTWLAIGSLAESLGDIERATASYNSALRHSPNNPDILVKI
ANTYRSKDQFLKAAELYEQALNFHVENGETWGLLGHCYLMLDNLQRAYAAYQRALFYLENPNVPKLWHG
IGILYDRYGSLEYAEEAFVRVLDLDPNFDKANEIYFRLGIIYKHQGKLQPALECFQYILNNPPHPLTQP
DVWFQIGSVYEQQKDWNGAKDAYEKVLQINPHHAKVLQQLGCLYSQAESNPSTPANGAAPPHKPFQQDL
TIALKYLKQSLEVDQSDAHSWYYLGRVEMIRGDFTAAYEAFQQAVNRDARNPTFWCSIGVLYYQISQYR
DALDAYTRAIRLNPYISEVWYDLGTLYETCNNQISDALDAYRQAERLDPNNPHIKARLEQLTKYQQEGN
THPPQPPPSSQQPRLPQGMVLESTQQQQQQQPPPPPQQQQQQLQHQSQSQPQPQQPPQTQSQPSLLQHQ
SSLPPQQIQPLHQQAAKPLVNQQQSPPPPHLMNLGQPGQQPQQLPPHLPPHTQQPSQIQEKPPTQEQPH
YQPPPPPQHQQQSQSQPQPPHQPQHTQNQSPQLAQLPPHHSNPPAKPHGAPQQRTGLPDLLHNSANIIS
APSQVPQPQQQYQQPHIAPVRQEQVNHVPSIYSAPRPTETTLPQINNPNESTTTQVPQLKKEEPKPEAT
VSAPVPEAIKVQDQVTIQESAPAAAAAVSAPASAPVGDIKTDTVSTTTPATSTTADAVPVSVSQVGEAP
NVVQEKKVPDTEQIVSQVEKPVESQPEVTPAPTPAPALATAPTEPAPTDKDVVMAPSKSATPVPQSIVE
QNTRVSEATKAPESNGKHDLEDKNDEEKILKRPTVETTTESVPVNQPVEKENEKVEVPPPSEQPSSEKR
EKEVNGSIKKPLENESKVDIPQFSSNITAQNEEAKSGEETKKDTTKTSPAKQGEVKEVIPSSTETVSKP
DVEKDNKEKDKDEDEVMADEDDVKKDENPEPPMRKIEEDENYDDE YDR145W_homolog 1536bp public: 1..1536(SEQ ID NO 467)
ATGGAAAGGTTCAATCAAATTAGACAAAAACTCACTGAAGTTCAAAGGAGGGTTCAGTTGTTGGAACAA
ACAAAGAAAACAGGAAATGTTACTCCAGAGCAAATTCAACAGATTGATAAAGAAATAATTGAATGCAAG
GCAAAGTTCCAACAGTATCAAAAAGTAGGGATTTATATTAGAAATCAGTTGGTTCTTCAAGCTAAAGCA
CAACAACAGAGACAATTGCAACAGCGACAGCAACAACAGCAACAGCAACAGCAACAGAATAACAATCTA
AAATCAGCTCAGAACCAGAACCAGAATCAAAACCAAAACCAAAACCAAAACCAAAACCAAAACCAAAAC
CAAATACAAGGAGTGCAATCTGCTGGACAAACACCTCAGCAACAGAGCTTTTCGCCACAGTTGCAGGCT
GTACAACAACAACAATTTATGGGCAACCTGCAACGAACAGCAGCAACAACAACAACTTAGAAAT
GCGAATAAAAGTGCACTTCAAGGTCAAGCTCCTTCACAGGCGCCAACTCCTTTACCTGTTCGGCCAACA
CCTCAGAGTCAACCTACAGCACAAGCGGGTGTTGCTTCACAGGCAGCTACACCAGGATTTCGAGCTTCT
CAACCCACACCATCGCAAACTTCGAGAACTGGATCAGCTCTACAACAAAGGGCACCAAGTCGACAGGCA
TCTTCTACACCGCAATCTCAATTCCAACCACCATTACCACTGGAGAGTCGACATCCTTCTGCAACTACA
TCAGAAAAGCCACTTCCCCAACAACCTGGAAGCGGAACAGCGAAGAGTCCTAGTGTTGCTGCTACTCCT
GCTCAGAATAATGGCACTGTAACTGCCCGGTCTGCATCACCTGTTGCAACTACTACAGATAGTGCTACA
ACTGGACGCTCAGGAACTCCCCAACAACAATCAAGGTCACGATCTGGATCATCGTTGAATTTGGCTGGC
ATTACACGTCAGTCTGTCCCATCATTGCCAATTTCGAGTTCTATTAATGTAAAACAGCCCACAATCACC
ACATTTAATAGTATCAATGATACGAGACCCAGTTTGACGGGAGGAGCTGCCAATCCTATGAGTATTTTA
TTAGATACACCAGCGATCACAAAATTGCCTACTTTTGATATCGAAGGAGACACTGGTGTCATTGATTCT
AGTACCAGTGGACGAGTTTTAAATAAACGAAAATTAGGTGATTTGATAAATACAATAGGTGTTGATGAA
GGGGATGGTAAGACCAGTATTGATGGGAATGTGGAGGAATTTTTGTTGGATTTGGCTGATGAATTTATT
CATTCAGTGACAAGTTTTGCTTGTCGGTTAGCAAAACATAGAAAGGTGGATAGTATAGAGGCAAGAGAT
GTTCAACTACATTTGGATAAGAATTGGAATATCAAGATTCCTGGTTATGCAATGGATGAGATTCGAAAC
ACAAGAAAAATACAACCTAGTAATAGTTATAGTCAGAAAGTACAAGGTGTCGAAGTTTCGAAAGCTGTG
AATGATGATAATGCTTAA YDR145W_homolog 511aa(SEQ ID NO 468)
MERFNQIRQKLTEVQRRVQLLEQTKKTGNVTPEQIQQIDKEIIECKAKFQQYQKVGIYIRNQLVLQAKA
QQQRQLQQRQQQQQQQQQNNNLKSAQNQNQNQNQNQNQNQNQNQNQIQGVQSAGQTPQQQSFSPQLQA
VQQQQFMGNSQQQQQQQQQQLRNANKSALQGQAPSQAPTPLPVRPTPQSQPTAQAGVASQAATPGFRAS
QPTPSQTSRTGSALQQRAPSRQASSTPQSQFQPPLPSESRHPSATTSEKPLPQQPGSGTAKSPSVAATP
AQNNGTVTARSASPVATTTDSATTGRSGTPQQQSRSRSGSSLNLAGITRQSVPSLPISSSINVKQPTIT
TFNSINDTRPSLTGGAANPMSILLDTPAITKLPTFDIEGDTGVIDSSTSGRVLNKRKLGDLINTIGVDE
GDGKTSIDGNVEEFLLDLADEFIHSVTSFACRLAKHRKVDSIEARDVQLHLDKNWNIKIPGYAMDEIRN
TRKIQPSNSYSQKVQGVEVSKAVNDDNA YDR154C_homolog 333bp public: 1..333(SEQ ID NO 469)
ATGATGTCGTTCCAAAGACTGCTGAAAATTTCAGAGCTTTATGTACTGGTGAAAAAGGTTTTGGTTACA
AAGGTTCTATTTTCCACAGAGTCATCCCACAATTCATGCTTCAAGGTGGTGATTTCACCAACTTTAACG
GTACTGGTGGTAAAAGTATTTACGGTACCAAATTTGCTGATGAAAACTTTGTCAAGAGACATGACAGAC
CAGGTTTGTTGTCTATGGCCAATGCTGGTCCAAACACCAATGGTTCCCAATTCTTCATTACCACCGTTC
CATGCCCATGGTTGGATGGTAAACACGTTGTTTTCGGTGAAGTCACTGATGGTTTAG YDR154C_homolog 110aa(SEQ ID NO 470)
MMSFQRSSKISELYVSVKKVLVTKVLFSTESSHNSCFKVVISPTLTVSVVKVFTVPNLSMKTLSRDMTD
QVCCLWPMSVQTPMVPNSSLPPFHAHGWMVNTLFSVKSSMV YDR216W_homolog 4257bp public: 1..4257(SEQ ID NO 471)
ATGATTTCACCAACTCACCAGAGTCAATACCTTAATTATTTTGTCAACCCAGTTTTAATGACTGAGTCC
GGAGATATTATTGATAGTGTCACTGGTACAACAACAACGACAGCAAACATGTCAAATACAACAATAGAT
GCGCCTACTCCCGCCTCGACTACCAAGAATTATAAGCACAAAAAACAGAATACCAATACTGGAACATCC
ATGTCGCCAAGTAATTCAATAAATTCAACAAACAACAATGCAGCGCAGCAGCAGCAGCAGCGACAACAACAACG
TCAAAAAAGTCCAAAGACATCCCATTAGAGTTGACTGCATTTGGTACAACCCCCTCTGGGAAACCACGT
TTATTTGTTTGTCAAGTCTGTACAAGAGCATTTGCTAGGTTAGAACATCTACGTAGACATGAAAGATCA
CACACAAAGGAAAAACCATTTAGTTGTGGTGTTTGTCAACGGAAGTTTAGTCGTCGAGATTTATTGCTA
AGACATGCACAGAAATTACACGCTGGCTGTACTGATGCAATAACAAGATTAAGAAGAAAATCAATTAAG
AAATCTCAGGATGGGGACGATGATGATGACGATGATGACGACGATGAAGAAATGGCAAATTCTGAAGAC
GAAAACGATCATGATGAATCGGGCAATGCAAGCACAAAGAATGGTAAAAAGGATAAAAAGATCCACCA
CCGGAGTTCAATTTAAATTTATTCAATCTGAAACAAAAGCCAACTAAAGCGAACACGACAAAGTCAAAA
GTGGCTAAATTATCAACAACGACATCAAGGAAAAATTCAACCAATCCTACGAGAAAAAACTCCAGCTCT
TTGCACAAGCAGGTTCTTGATCAACGTCAAAAGGCTGCCGTTAATACAAAAATTGTATCAAGTACCAAA
ATTGTATCAGGTACCAATAGTGGAGTGTCGATAACTCCAACAAGGTCTAGAAGAGGTGCATCATTTTCT
GCTCAATCGGGTGCCAACTATGCCATCAACATACCTGAGTTTAATGATATATATCCACAATCTGATAAT
GTTGAATTTTCAACCCCTCAATTCTTACCATCTTCATTGGATAATGAAATGACGTGGCTAAATAATATT
CCAAACATTCCCGGATTGTCTGATTCTGTGTCGGCTGCAAACTTGATGCGTCAGAATTCCATAACAAAT
TCAGCAGATCATGTAACACCTCCAGTAAACGTGAGTCAGCATGGGTCATTTTCTCATCAATCAACATTT
TCAGCTACCGATATGGGACAAACAAGATCCGAAAGTGTAAACAGTTTAAACACTCCATTTGATGGTTCC
TACATGATGCCAACGGTAACAATAAGCAATCAAGAAATCCAAAATGGTGTTGCTGCTCATCATCATCAT
CAACAACAACAGCAGCACCAGCAGCACAATCATCAACATCAACCAAATCAGTCTCTGCTCGGGTTATCG
AGAAATGACATGTTAAGTGAAGATCACTATGGCTATTCATTTTATGATATCCCGGAGAATATTCTCAAT
TTCCCAATGGATTCTATATCAACAACTTCAAATGCAATGTCTTCGGGCCCAATTCAAAACTTTAAACCA
TTATCGCCTATCACACAAGAAATTGAACATGAGATTACTCCAAGAATTGATGGAAGAATTGGGGATTTC
CAAAATAACAACAATACCAATGATAATCCGATTCACCAAAATATCAATTATGACTTGAACTTTCTTCAT
ACTATTGATGATATAGGACAAGATGTTATTTCTAAATTTATGCCAGGAGGTTACTCGTTTTATGGAGAC
AATAATGTGTCGGCAACTTCTTCAGCTAATGACTACAACTCACCGAACAATATTGTTTCACCGAGCCA
CAAAACAATCAATTTGCTCTTCACAACCAGTCGTCACATCCTAGTGGTGCTTCACCACATTTAAACCAA
GCAATGATGAATAAAATGAGGTTGCATAACTATTCTAGCAACAAATTATTCACTAATCATATAAGACAC
ATGATAAATAAGGCATTGGGTAAATACCCCATAAGCGGCATAATGACACCTACTATACCCTCAAATGAG
AAACTAGAGTTTTATTTGAGTGTTTTCATTCAATCATTTTTGGCACACCTCCCATTTATACATCCTTCT
AAAATTGAATGAATATGAAATTATGGCCATGACTGGTAATGAAGATATAAACAATGAAAGTGCTAGAGTT
TGTTTGCCATTATTAACAGCGACCATGGGGGCCTTGTTGGCCAATAACAAAAACGATGCTGAACATCTT
TATGAAGCCTCACGAAGAACAATACACATTTATCTAGAGAGTAGAAAAACAAATTCTACTAACGACAAG
AATTACAAGAATGGTAAGGATAAAAGCTCATCCGGTAATCCATTATGGTTACTTCAATCACTAATGTTG
TCTGTTCTTTACGGATTATTTTCAGATAATGAAAATAATGTTTATATTGTTATCCGTCAATTGAACGCC
TTAAACTCATTAGTTAAGACATCCATAAAAAATAAAGGGCCAATTTTCTTTTCAAACAATGGCGAAGAT
GAAGAACTTTATAATAAGTTAAATTCTCATGATAATGGTACTTCCTTATTTTCCAATAATTTGAATGAT
GAAATGCGATACAAAAATAATATAAACATGCAATCTCAAACGAGAATAGTATTTATCATTTATCGGTTG
ACGAACTTTTTGTTGATGATGTACAATGTACCGTTAACTTTCTCAATCAATGATATTAATCAATTGGCA
GTCACTTCCAAAGATGAAGAAACTTTATGGAACTTTAAAAATTATCAAGAGTTTCAAGAGTTTTCTCAT
AAGAATAACAAGACTTTAGATGATTATTTGAATAATAAGATGAGCCAATAATTTTCCGCGAATTATTG
TTGACAGTTATCAAATTTGGTATTTCAGATAGTAACATTTCACCAGAGATTGAAAAGAAAGTTACACAC
CAATTGCAGAATCTTTGTAAATATGGATTCAATTGTTTGGTGCATGGTATATATGAAATCAAACAATAT
CAAGAGATGAAAGAAGTAGATACATTCAAAGTGTTGGATTATTTAACCAAGTTTTATCCTACAAATGAT
GGATTGGGGTTCAATTGCTTTAGATTACCTGCCAATAAAGACTTGGAAAAGATTGATTATGCCTTATTA
GTAGATTTTACTAAAATTTCATCGATAATAGATCTTAAATTGCTTAAAGAACAAAGTTGGCTTAAAAAT
TATCAAGATTTAACTCAAAATTATCATCGTCTTTTGGATGCTCACAGTACTGGGAATCCACTTAATTCA
ATTAATGATTATGATTTTGAAACTTGCTGTTGTATTCTGGTACTCAAATTGATATTATTTAAA
GTTGAGGATTCCAACAGTAATAGTAGAAATCGAAGCAAAAATGATCCAACAAATGAAATCAATAACAAA
CTCAACAACAACAACAACAATAACAATGATATGAATAATAATAACAGTAATGGTGATCAATTAATTTCT
GCCTTTGATACTGATTTTGGATATTTGAATATGGATAATAATGGTTATGCCAAAAAGAAGAATTTTTA
CGATTCACTGATGATGAGTTGCGATATGATAAAGAAACACGATGTCATATTTGATAAACATATTAAA
CTTGATATATTTGAAGAAGTTGAGAAATCAAGTAATTTGATACAAGCACAAATGTTATTCCATGCATTT
TCCGTATTATCGATTTTTTCGGTTTATGTTATGCGTAAAAATGATAATAATTCATCACCATTTGCTAAT
ACTGATTTAATATTTGAATTGAATCATAGATATAGTATGGTTCTTAGATTATTAGAAAGACTTGAAACT
TTTTTGAAATTGAGATATCAAACATCAGCAGGAGGGAGGAGGAGGTGTTAACAATAACAATAACAAC
GCCTTATCTATAAAATTAGAACAAGAATTCACAAACTTGTATCTTTACAATGGGAATGTATTATCTTCA
GATCATAATACAAATACAAATACCACCAATACTATTACTACTACTACTACTACAGACAATGGTACTAAA
CAAAATCAGCATCATTCACAAGATTTTGGATTAGAAAAGACTTTATATATCTTAAAAATGGGAGAAAAT
GTTTTGAATTATATTTATGATTTAAATTTAAAAGTTTGCGTATTTAAGAAATTGGGTGATAGTTTATCA
GAAATTAGAAAATATTTAATTGATAATGAATCTACTTTGAATGGTTAA

```
YDR216W_homolog 1418aa(SEQ ID NO 472)
MISPTHQSQYLNYFVNPVLMTESGDIIDSVTGTTTTTANMSNTTIDAPTPASTTKNYKHKKQNTNTGTS
MSPSNSINSTNNNAAAAAATTTTSKKSKDIPLELTAFGTTPSGKPRLFVCQVCTRAFARLEHLRRHERS
HTKEKPFSCGVCQRKFSRRDLLLRHAQKLHAGCTDAITRLRRKSIKKSQDGDDDDDDDDDEEMANSED
ENDHDESGNASTKNGKKDKKDPPPEFNLNLFNSKQKPTKANTTKSKVAKLSTTTSRKNSTNPTRKNSSS
LHKQVLDQRQKAAVNTKIVSSTKIVSGTNSGVSITPTRSRRGASFSAQSGANYAINIPEFNDIYPQSDN
VEFSTPQFLPSSLDNEMTWLNNIPNIPGLSDSVSAANLMRQNSITNSADHVTPPVNVSQHGSFSHQSTF
SATDMGQTRSESVNSLNTPFDGSYMMPTVTISNQEIQNGVAAHHHHQQQQQHQQHNHQHQPNQSSLGLS
RNDMLSEDHYGYSFYDIPENILNFPMDSISTTSNAMSSGPIQNFKPLSPITQEIEHEITPRIDGRIGDF
QNNNNTNDNPIHQNINYDLNFLHTIDDIGQDVISKFMPGGYSFYGDNNVSATSSANDYNSPNNIVSPSQ
QNNQFALHNQSSHPSGASPHLNQAMMNKMRLHNYSSNKLFTNHIRHMINKALGKYPISGIMTPTIPSNE
KLEFYLSVFIQSFLAHLPFIHPSKLNEYEIMAMTGNEDINNESARVCLPLLTATMGALLANNKNDAEHL
YEASRRTIHIYLESRKTNSTNDKNYKNGKDKSSSGNPLWLLQSLMLSVLYGLFSDNENNVYIVIRQLNA
LNSLVKTSIKNKGPIFFSNNGEDEELYNKLNSHDNGTSLFSNNLNDEMRYKNNINMQSQTRIVFIIYRL
TNFLLMMYNVPLTFSINDINQLAVTSKDEETLWNFKNYQEFQEFSHKNNKTLDDYLNNKNEPIIFRELL
LTVIKFGISDSNISPEIEKKVTHQLQNLCKYGFNCLVHGIYEIKQYQEMKEVDTFKVLDYLTKFYPTND
GLGFNCFRLPANKDLEKIDYALLVDFTKISSIIDLKLLKEQSWLKNYQDLTQNYHRLLDAHSTGNPLNS
INDYDYLKLADCCISVLKLILFKVEDSNSNSRNRSKNDPTNEINNKLNNNNNNNNDMNNNNSNGDQLIS
AFDTDFGYLNMDNNGYAKKEEFLRFTDDELRYDKENTMSYFDKHIKLDIFEEVEKSSNLIQAQMLFHAF
SVLSIFSVYVMRKNDNNSSPFANTDLIFELNHRYSMVLRLLERLETFLKLRYQTSAGGGGGGVNNNNNN
ALSIKLEQEFTNLYLYNGNVLSSDHNTNTNTTNTITTTTTTDNGTKQNQHHSQDFGLEKTLYILKMGEN
VLNYIYDLNLKVCVFKKLGDSLSEIRKYLIDNESTLNG YDR224C_homolog 393bp public: 1..393(SEQ ID NO 473)
ATGGCCCCAAAAGCAGAAAAGAAACCAGCTTCCAAAGCTCCAGCTGAAAAGAAACCAGCTGCTAAGAAA
ACCGCTTCCACCGATGGTGCTAAAAAGAGAACCAAAGCTAGAAAAGAAACTTATTCCTCATATATATAT
AAAGTTTTGAAACAAACACATCCAGACACTGGTATCTCCCAAAAGGCCATGTCAATTATGAATTCGTTT
GTTAACGATATTTTCGAAAGAATTGCCACCGAAGCCTCCAAATTAGCTGCTTACAATAAAAAATCCACA
ATTTCCGCTAGAGAAATCCAAACTGCTGTTAGATTAATTTTGCCAGGTGAATTGGCCAAACATGCCGTT
TCCGAAGGTACCAGAGCCGTCACAAAATACTCATCTGCTTCTAGTTAG YDR224C_homolog 130aa(SEQ ID NO 474)
MAPKAEKKPASKAPAEKKPAAKKTASTDGAKKRTKARKETYSSYIYKVLKQTHPDTGISQKAMSIMNSF
VNDIFERIATEASKLAAYNKKSTISAREIQTAVRLILPGELAKHAVSEGTRAVTKYSSASS YDR342C_homolog 1653bp public: 1..1653(SEQ ID NO 475)
ATGTCATTAGATAATTCAACAGAAAACCGTGATTTGGAAGAAAAGGAAGAAATTCCAAAGAACGAACAT
AACGAACAAGGCGAACAAAACGAGAACAATGAGCATATACCTACTTTGGAAGATAAACCATTGAAGGAA
TATATTGGTATTAGTATTTTGTGTTTCCTTATTGCCTTTGGTGGTTTCGTTTTCGGTTTCGATACTGGT
ACCATTTCTGGTTTCATTAACATGACTGACTTTTTAGAAAGATTTGGTGGTACTAAAGCTGACGGTACT
CTTTACTTTTCCAACGTTAGAACTGGTTTATTGATTGGTTTGTTCAATGTGGGTTGTGCCATTGGTGCA
TTATTCTTTGTCTAAAGTCGGTGATATGTATGGTAGAAGAGTTGGTATCATGACTGCTATGATCATTTAT
ATTGTTGGTATTATTGTTCAAATTGCTTCTCAACATGCTTGGTATCAAATCATGATTGGTAGAATTATC
ACTGGTCTTGCTGTTGGTATGTTATCAGTTTTGTGTCCATTATTTATCTCAGAGGTTTCTCCCAAACAT
TTAAGAGGTACATTAGTTTATTGTTTCCAATTGATGATTACCTTGGGTATTTTCTTGGGTTACTGTACC
AGTTACGGTACTAAGAAATATTCTGACTCCAGACAATGGAGAATTCCATTGGGTTTATGCTTTGCTTGG
GCCTTGTGTTTGCTTGGTGGTATGGTAAGAATGCCAGAATCTCCACGTTACCTTGTCGGTAAAGATAGA
ATTGACGATGCTAAGATTTCACTTGCCAAAACTAACAAGGTTTCTCCAGAGGACCCTGCATTATACCGT
GAACTTCAATTAATCCAAGCTGGTGTTGAAAGAGAAAGATTGGCCGGTAAGGCATCTTGGGGTGCTTTA
ATCACTGGTAAACCAAGAATCCTTGAAAGAGTTATTGTTGGAGGTATGTTGCAATCATTGCAACAATTG
ACTGGTGATAACTATTTCTTCTACTACAGTACCACCATTTTCAAGTCTGTCGGTTTAAATGATTCCTTC
GAAACATCTATTATCCTTGGTGTCATCAACTTTGCTTCCACTTTTGTTGGTATTTATGCCATTGAAAGA
TTGGGTAGAAGACTCTGTTTATTAACTGGTTCCGTTGCCATGTCCATTTGTTTCTTAATTTACTCATTG
ATTGGTACTCAACATCTTTACATTGATCAACCAGGTGGTCCAACCAGAAAACCAGATGGTAACGCTATG
ATTTTCATTACTGCACTTTATGTTTTCTTCTTCGCTTCTACATGGGCTGGTGGTGTCTACTCCATTGTT
TCTGAACTTTATCCATTAAAAGTCAGAAGTAAGGCTATGGGTTTTGCTAATGCATGTAACTGGTTGTGG
GGTTTCTTGATTTCCTTCTTCACTTCATTTATCTGATGCTATCCACTTCTATTATGGTTTTTGTGTTT
ATGGGCTGTTTAGTGTTTTCCATTTTCTTTGTTTACTTTTATGATTTACGAAACTAAAGGTCTTACTTTA
GAGGAAATTGATGAATTATACTCTACCAAGGTTGTTCCATGGAAATCAGCCGGTTGGGTTCCACCTTCT
GACGAAGAAATGGTTCGTGCAAAAGGCTATACTGGTGATATCCACGCAGATGAAGAGCAAGTTTAA
```

YDR342C_homolog 550aa(SEQ ID NO 476)
MSLDNSTENRDLEEKEEIPKNEHNEQGEQNENNEHIPTLEDKPLKEYIGISILCFLIAFGGFVFGFDTG
TISGFINMTDFLERFGGTKADGTLYFSNVRTGLLIGLFNVGCAIGALFLSKVGDMYGRRVGIMTAMIIY
IVGIIVQIASQHAWYQIMIGRIITGLAVGMLSVLCPLFISEVSPKHLRGTLVYCFQLMITLGIFLGYCT
SYGTKKYSDSRQWRIPLGLCFAWALCLLGGMVRMPESPRYLVGKDRIDDAKISLAKTNKVSPEDPALYR
ELQLIQAGVERERLAGKASWGALITGKPRILERVIVGGMLQSLQQLTGDNYFFYYSTTIFKSVGLNDSF
ETSIILGVINFASTFVGIYAIERLGRRLCLLTGSVAMSICFLIYSLIGTQHLYIDQPGGPTRKPDGNAM
IFITALYVFFFASTWAGGVYSIVSELYPLKVRSKAMGFANACNWLWGFLISFFTSFITDAIHFYYGFVF
MGCLVFSIFFVYFMIYETKGLTLEEIDELYSTKVVPWKSAGWVPPSDEEMVRAKGYTGDIHADEEQV YDR343C_homolog 1641bp public: 1..1641(SEQ ID NO 477)
ATGTCTCAAGACAACGTCTCATCAACATCTACAGCTGAGGCTGTAAATAATGAAATCAAAGTCAAAGAT
GAATTTCGACAAGAAGAACAAGCTCATACTAGTTTAGAAGATAAACCTGTGAGTGCATACATTGGTATC
ATCATTATGTGTTTCCTTATTGCCTTTGGTGGTTTCGTTTTTGGTTTCGATACTGGTACTATTTCCGGT
TTCATTAATATGTCTGACTTTTTAGAAAGATTCGGTGGTACTAAAGCTGACGGTACTCTTTACTTTTCC
AATGTCAGAACTGGTTTAATGATTGGTTTGTTCAACGCTGGTTGTGCCATTGGTGCATTATTCTTGTCT
AAAGTCGGTGATATGTATGGTAGAAGAGTTGGTATCATGACTGCTATGATTGTCTATATTGTTGGTATT
ATTGTTCAAATTGCTTCTCAACATGCTTGGTATCAAGTCATGATTGGTAGAATTATCACTGGTCTTGCC
GTTGGTATGTTATCAGTTTTATGTCCTTTGTTCATTTCCGAGGTTTCTCCAAAACATTTGAGAGGTACT
TTGGTGTGCTGTTTCCAATTGATGATTACCTTGGGTATCTTCTTGGGTTATTGTACTACCTATGGTACT
AAGAGTTACTCAGACTCTAGACAATGGAGAATTCCATTAGGTTTATGTTTTGCTTGGGCTTTATGTTTG
GTTGCTGGTATGGTTAGAATGCCAGAATCTCCACGTTACCTTGTCGGTAAAGACAGAATTGAAGATGCT
AAAATGTCACTTGCTAAAACTAACAAAGTTTCCCCAGAGGACCCAGCCTTATACCGTGAACTTCAATTA
ATTCAAGCTGGTGTTGAAAGAGAAAGATTAGCCGGTAAGGCATCTTGGGGTACTTTATTCAATGGTAAA
CCAAGAATCTTTGAAAGGGTTGTTGTTGGTGTCATGTTACAAGCCTTACAACAATTGACTGGTGATAAC
TATTTCTTCTACTACAGTACCACTATTTTCAAGTCCGTTGGTATGAATGATTCTTTCCAAACTTCTATC
ATTATTGGTGTTATTAACTTTGCGTCCACTTTTGTTGGTATTTATGCTATTGAAAGAATGGGTAGAAGA
CTCTGTTTGTTAACTGGTTCCGTTGCCATGTCTGTCTGTTTCTTAATCTATTCCTTGGTTGGTACTCAA
CATCTTTATATTGACAAACCAGGTGGTGCTAGTAGAAAACCAGATGGTGATGCCATGATCTTTATGACT
TCACTTTATGTGTTCTTCTTTGCTTCTACATGGGCTGGTGGTGTTTACTCCATTATTTCTGAACTTTAT
CCATTGAAAGTTAGAAGTAAGGCTATGGGTTTAGCTAATGCTTCCAATTGGACCTGGGGTTTCTTAATT
TCTTTCTTTACTTCATTTATTACTGATGCTATCCACTTCTACTACGGTTTCGTCTTTATGGGATGTTTA
GTTTTCTCCATTTTCTTTGTCTACTTTATGGTTTACGAAACTAAAGGTCTTACCTTGGAAGAAATTGAT
GAATTGTACTCCACCAAAGTCCTTCCATGGAAATCAGCTGGTTGGGTGCCACCTTCCGAAGAAGAAATG
GCAACCTCTACGGGATATGCTGGTGATGCCAAACCAGAAGAGGAACACGTTTAA YDR343C_homolog 546aa(SEQ ID NO 478)
MSQDNVSSTSTAEAVNNEIKVKDEFRQEEQAHTSLEDKPVSAYIGIIIMCFLIAFGGFVFGFDTGTISG
FINMSDFLERFGGTKADGTLYFSNVRTGLMIGLFNAGCAIGALFLSKVGDMYGRRVGIMTAMIVYIVGI
IVQIASQHAWYQVMIGRIITGLAVGMLSVLCPLFISEVSPKHLRGTLVCCFQLMITLGIFLGYCTTYGT
KSYSDSRQWRIPLGLCFAWALCLVAGMVRMPESPRYLVGKDRIEDAKMSLAKTNKVSPEDPALYRELQL
IQAGVERERLAGKASWGTLFNGKPRIFERVVVGVMLQALQQLTGDNYFFYYSTTIFKSVGMNDSFQTSI
IIGVINFASTFVGIYAIERMGRRLCLLTGSVAMSVCFLIYSLVGTQHLYIDKPGGASRKPDGDAMIFMT
SLYVFFFASTWAGGVYSIISELYPLKVRSKAMGLANASNWTWGFLISFFTSFITDAIHFYYGFVFMGCL
VFSIFFVYFMVYETKGLTLEEIDELYSTKVLPWKSAGWVPPSEEEMATSTGYAGDAKPEEEHV YDR544C_homolog 1700bp(SEQ ID NO 479)
CTAAAGTCCAAAGTTGGTTCAATTTTTGGCAGAAAAAAGAAGAAGGAAAAATTCACTGGA
GCTGATTCAATTGCTGAAGATGAATCATTATCTGAGGTTTCTTTGCCACCTACAAGAACT
AGGAATTCATCGGTGTTGTCTCGCAGTAACTCAACTAGAAGATCTTTTATTGACCGCTTC
CATAGAGATGAGTCTAGCACTGGCATTAGCAGACAACATGAGCAGCACCAGCAGCCTTTG
AGTGATCCTTTGCCTCACGCAGAGAAGCCTCAACCGGAAATTCCCCAATCACCAGAAGCT
CCACAGGCCAAATCACTAGAGCCTGTATCAGAAGTACTAAAAGAACTGTTCCCACCTATG
CAAAACGGGTCCGAAAGGAAAGGTGAAAATCAGCAGTCGAGAGTTGATGTATCCTCTCAA
ACCTTGTCACCAGTTACTCCTACTCACGATGGATTTGGTGGTTCTGTTAAACCATTACCA
GAACCTGTTGATTCTCCAAATGTGATTAAATACAATGACTCGGACGACTCTTCTACAGAA
GAACGTAGAGGCTCGTTACTTGAAAAACACAATTTAGAAGTACAACCTGTATCTTCCCCA
TTCACTACTCAACCGCCAGCACCTGTGCCACAAGAATCCAGATCTAGACAAAGCAGTGAT
GGCATTTACTCGTTTGAAGCGGGTGATGATTCCAACCCAATCTCGGCTACTCCAAGATCC
GAGCAAAATGTGTTTGGACAGATGCCAGACCCAAATTTGTCTCCTGAAAAGACTCTTGCT
CCACCACCACCACCTTCGAGAAAAGTTTTGCACCATGAAGAACCAACTGTAAGGGATTCA GCTCTTTTCCACAATTTACCTGCTGCCTCCCATTCTGGAAGAGATTCGGTAATGGCTCCA
TTAGCAAGTCAAGACAGGGGTCATTCGTTGTTGAAAAATGATTTCAAACACGAAAACTTG
GCATCCACCCTCGGATTGAGCTCTTCTATTGCTGAAGTCATCAATGCCAGCTTTAAGGAT
GGACAGTTGATTAAATCACAAGTAGTTGGTGAAGTGGCCTTCAATTATAATGGTAATGCT
TCCGATCCACTTGTGGTCACTATTCCTAATAGTTTCGATAAAGTACTCGTGAACAAGACT
TTTATTGAGGATTTAGGTCAAAGCAAGTATAAAGTGAACCCAACTTCAATTACGTCTAAA
ACTCTTGGTGGGTTGAAATATCTTTTGAAACCAACACAGGTACCAGTGATAATTCAACAA
ATATGGAAATTTGAACCTCATCAGTCAAGTTTGATGGTTAGCATTCGTTCAACTACACCT
TTGGTATTGGAAAATTTTGTTGTCTCTGTAGCTTTGAATCAAGACATTGAAGCAACATCT
GCTTCCTCAAAGCCTCAAGGTGCGTTTAATAAAGAGAAAAACAGAATAACATGGAGATAT
CCACAGTCCCTCGCATTGAATGGTGTAGAGCGTTTGATAGCTAGATTTATGACTAATGGA
TTGGGTTCCGAACATGAGTCTGGTGTGCAGATTAAATTTCAAGTTAAGGATCCACAAGTC
AAGTACTGTAGTATTTACAGTGAGAATGGCGAAGAGATTCCTACGTTTAGAAATTTGGTT
AGCGGTAGTTATAGTGGTCATCTTTAAGTTATCTGTTTTGAGATTAGTCTCTTGTTGAAT
TGAAAAAAAAAAAAACGTGA YDR544C_homolog 548aa (SEQ ID NO 480)
LKSKVGSIFGRKKKKEKFTGADSIAEDESLSEVSLPPTRTRNSSVLSRSNSTRRSFIDRF
HRDESSTGISRQHEQHQQPLSDPLPHAEKPQPEIPQSPEAPQAKSLEPVSEVLKELFPPM
QNGSERKGENQQSRVDVSSQTLSPVTPTHDGFGGSVKPLPEPVDSPNVIKYNDSDDSSTE
ERRGSLLEKHNLEVQPVSSPFTTQPPAPVPQESRSRQSSDGIYSFEAGDDSNPISATPRS
EQNVFGQMPDPNLSPEKTLAPPPPPSRKVLHHEEPTVRDSALFHNLPAASHSGRDSVMAP
LASQDRGHSLLKNDFKHENLASTLGLSSSIAEVINASFKDGQLIKSQVVGEVAFNYNGNA
SDPLVVTIPNSFDKVLVNKTFIEDLGQSKYKVNPTSITSKTLGGLKYLLKPTQVPVIIQQ
IWKFEPHQSSLMVSIRSTTPLVLENFVVSVALNQDIEATSASSKPQGAFNKEKNRITWRY
PQSLALNGVERLIARFMTNGLGSEHESGVQIKFQVKDPQVKYCSIYSENGEEIPTFRNLV
SGSYSGHL YEL071W_homolog 1584bp public: 1..1584 (SEQ ID NO 481)
ATGCAGAGGAGATTAGTACAGACTGCTTCGTATTTGATTAGACGAAACAACGTGGCATGTAGATTCAGT
CGTTATAATGGTTTGCCCGTTGCATCTTATTCTACAAAAACAGTACCTTTTACGGCAGATACTTATTCC
CAAAAAGTCCAACGTGATGCAAAATTCAAGCAACTTGAATCTCAAGACATCGAATACTTTAAAAGTGTA
TTACCTGAGAATTCCATTATTACTGATGAAGACGACTTATTGTTTTTCAACGAAGACTGGATGAGAAAG
TATAGAGGTCAATCACAATTGGTTTTGAAACCGAAAACCACCGAACAAGTCGCTTCTATCTTAAAGTAT
TGTAATGATAACAAGCTAGCTGTTGTACCACAGGGTGGGAATACTGGGTTGGTAGGTGGATCTAATCCA
ATTTTTGATGAAATCATCATTTCCTTGTCGGCCATGAATAAAATCAGATCGTTTGATCCTGTCAGCGGT
ATATTGAAAGTCGACGCTGGTGTTTATTTTGGAAACAGCTGATCAGTATTTGGCTGAGCAGGGCTACATT
TTCCCGCTCGACTTGGGAGCTAAAGGGTCGTGTCATGTTGGTGGCAATGTTGCATGTAATGCTGGTGGT
TTGCGTTTGTTACGATACGGTTCTTTGCATGGTTCTGTTTTAGGTTTGGAAGCTGTCTTGCCCGACGGT
ACAGTTTATAACTCTATGCATTCATTGCGTAAAGATAATACTGGTTATGATTTGAAGCAGTTGTTTATT
GGATCTGAAGGTACTTTGGGTATTATAACTGGTGTTTCGATTCTATGTCCATCAAGACCACAAGCGCAA
AATGTGGCATTTTTAGCTGTATCGAGTTATGAGGCCGTTCAAAAGGTTTTTGTCCAGGCTAGAAAGGAG
TTGCAAGAAATTTTATCGGCTTTTGAATTCATGGACAACACCTCACAAAAGTTGACTGCTAAGCATTTA
GGTTTGGAGCACCCTATTGAAAGCGGTGACTTCCCATTCTATGTGTTAATTGAAACCTCTGGCTCCAAC
AAAGAGCACGACGACGAAAAATTGGAAACATTCTTGGGGAATGCAATGGAAGAAGGTTTAGTCGACGAT
GGGATTATTGCACAAGATGAGGCTCAAATACAATCATTATGGTCATGGAGAATCCATCCCTGAAGCA
ACCACTATTGGAGGCGGTGTTTACAAGTATGACGTTTCTATTCCATTGGCAGATCTTTACGGGTTAGTT
GAGGACATCAATACCAGGTTAAATGATGCTGGAATCGCCAGCTTGGACGATGAATCGAAACTTGTGCTT
GCTGCATTGGGTTATGGTCACATTGGAGATGGAATTTACACTTGAACGTTTCTGTGAGAAAGTATTCT
CCTGAAATTGAAACTATCTTGGAGCCATTTGTCTATGAATGGATCGCAAAAAAAATGGATCCATTTCG
GCTGAACATGGGTTGGGATTCCAAAAGAAAAACTACATTGGGTATTCCAAGAATGAGATTGAGGTCAAA
TTAATCAAAGAAATCAAACAACATTACGATCCAAATGGAATCATGAACCCATATAAATACGTGTAA YEL071W_homolog 527aa (SEQ ID NO 482)
MQRRLVQTASYLIRRNNVACRFSRYNGLPVASYSTKTVPFTADTYSQKVQRDAKFKQLESQDIEYFKSV
LPENSIITDEDDLLFFNEDWMRKYRGQSQLVLKPKTTEQVASILKYCNDNKLAVVPQGGNTGLVGGSNP
IFDEIIISLSAMNKIRSFDPVSGILKVDAGVILETADQYLAEQGYIFPLDLGAKGSCHVGGNVACNAGG
LRLLRYGSLHGSVLGLEAVLPDGTVYNSMHSLRKDNTGYDLKQLFIGSEGTLGIITGVSILCPSRPQAQ NVAFLAVSSYEAVQKVFVQARKELQEILSAFEFMDNTSQKLTAKHLGLEHPIESGDFPFYVLIETSGSN
KEHDDEKLETFLGNAMEEGLVDDGIIAQDEAQIQSLWSWRESIPEATTIGGGVYKYDVSIPLADLYGLV
EDINTRLNDAGIASLDDESKLVLAALGYGHIGDGNLHLNVSVRKYSPEIETILEPFVYEWIAKKNGSIS
AEHGLGFQKKNYIGYSKNEIEVKLIKEIKQHYDPNGIMNPYKYV YER177W_homolog 795bp public: 1..795(SEQ ID NO 483)
ATGCCAGCCTCCCGTGAAGATTCCGTTTACCTTGCTAAATTAGCCGAACAAGCAGAACGTTATGAAGAA
ATGGTTGAAAACATGAAAGCCGTTGCTTCCTCTGGCCAAGAATTGTCTGTTGAAGAACGTAATTTATTA
TCTGTTGCTTACAAGAATGTCATTGGTGCTCGTCGTGCTTCTTGGAGAATTGTTTCATCAATTGAACAA
AAAGAAGAAGCCAAAGGAAATGAGAGCCAAGTTGCTTTGATCAGAGATTACCGTGCCAAGATTGAAGCT
GAATTGTCTAAAATTTGTGAAGATATTCTCTCTGTGTTGAGCGACCATTTAATTACATCTGCCCAAACT
GGTGAATCAAAAGTATTTTACTACAAGATGAAAGGTGATTACCACAGATACTTGGCTGAATTTGCTATC
GCTGAAAAACGTAAGGAAGCTGCTGATTTATCATTAGAGGCTTATAAAGCTGCTTCTGACGTTGCTGTG
ACCGAGTTGCCACCAACCCATCCAATCAGATTAGGTTTAGCATTGAACTTCTCTGTTTTCTACTATGAA
ATTTTGAACTCCCCAGATAGAGCTTGTCATTTAGCTAAACAAGCTTTCGATGATGCTGTTGCTGATTTA
GAAACCTTATCTGAAGATTCATACAAGGATTCAACTTTGATTATGCAATTATTGAGAGATAACTTGACT
TTATGGACCGATTTATCTGAAGCCCCAGCTGCCACTGAAGAACAACAACAATCCAGTCAAGCTCCAGCT
GCTCAACCAACAGAAGGTAAGGCTGATCAAGAATAG YER177W_homolog 264aa(SEQ ID NO 484)
MPASREDSVYLAKLAEQAERYEEMVENMKAVASSGQELSVEERNLLSVAYKNVIGARRASWRIVSSIEQ
KEEAKGNESQVALIRDYRAKIEAELSKICEDILSVLSDHLITSAQTGESKVFYYKMKGDYHRYLAEFAI
AEKRKEAADLSLEAYKAASDVAVTELPPTHPIRLGLALNFSVFYYEILNSPDRACHLAKQAFDDAVADL
ETLSEDSYKDSTLIMQLLRDNLTLWTDLSEAPAATEEQQQSSQAPAAQPTEGKADQE YGR192C_homolog 1008bp public: 1..1008(SEQ ID NO 485)
ATGGCTATTAAAATTGGTATTAACGGTTTCGGTAGAATCGGTAGATTAGTCTTAAGAGTTGCTTTGGGC
AGAAAAGACATTGAAGTTGTCGCCGTCAACGATCCATTCATTGCTCCAGACTATGCTGCTTACATGTTC
AAATACGATTCTACTCACGGTAGATACAAGGGTGAAGTCACTGCTTCTGGTGACGACTTGGTCATTGAT
GGTCACAAGATTAAAGTTTTCCAAGAAAGAGACCCAGCTAACATTCCATGGGGTAAATCTGGTGTTGAC
TACGTTATTGAATCCACCGGTGTTTTCACCAAACTCGAAGGTGCTCAAAAACACATTGATGCTGGTGCC
AAAAAAGTTATCATCACTGCTCCATCTGCTGATGCCCCAATGTTTGTTGTCGGTGTTAACGAAGACAAA
TACACTCCAGACTTGAAGATTATCTCCAATGCTTCTTGTACCACCAACTGTTTGGCTCCATTAGCTAAA
GTCGTCAACGATACTTTCGGTATTGAAGAAGGTTTGATGACCACTGTCCACTCCATCACTGCTACCCAA
AAGACCGTTGACGGTCCATCCCACAAGGACTGGAGAGGTGGTAGAACTGCTTCTGGTAACATTATCCCA
TCTTCCACTGGTGCTGCTAAAGCCGTTGGTAAGGTTATTCCAGAATTGAACGGTAAATTGACTGGTATG
TCTTTGAGAGTCCCAACCACCGATGTTTCCGTTGTTGACTTGACTGTCAGATTGAAGAAAGCTGCTTCT
TACGAAGAAATTGCTCAAGCTATCAAGAAAGCTTCTGAAGGTCCATTGAAAGGTGTTTTGGGCTACACT
GAAGATGCTGTTGTCTCCACCGATTTCTTGGGTTCAAGCTACTCATCTATCTTTGATGAAAAAGCCGGT
ATCTTGTTGTCCCCAACTTTCGTCAAATTGATTTCCTGGTACGATAACGAATACGGTTACTCCACCAGA
GTTGTTGACTTGTTGGAACACGTTGCTAAAGCTTCTGCTTGA YGR192C_homolog 335 aa(SEQ ID NO 486)
MAIKIGINGFGRIGRLVLRVALGRKDIEVVAVNDPFIAPDYAAYMFKYDSTHGRYKGEVTASGDDLVID
GHKIKVFQERDPANIPWGKSGVDYVIESTGVFTKLEGAQKHIDAGAKKVIITAPSADAPMFVVGVNEDK
YTPDLKIISNASCTTNCLAPLAKVVNDTFGIEEGLMTTVHSITATQKTVDGPSHKDWRGGRTASGNIIP
SSTGAAKAVGKVIPELNGKLTGMSLRVPTTDVSVVDLTVRLKKAASYEEIAQAIKKASEGPLKGVLGYT
EDAVVSTDFLGSSYSSIFDEKAGILLSPTFVKLISWYDNEYGYSTRVVDLLEHVAKASA YGR243W_homolog 399bp public: 1..399(SEQ ID NO 487)
ATGGCTTCAACAGTTCAACACGCATCCAAATTCCAACGTTTTTTAAATTCAGAGACCGGTCCTAGAACC
GTGCATTTTTGGGCTCCAGTGTTCAAATGGGCCTTAGTTGCTGCTGGACTTAATGACATACAACGTCCT
GTTGAAAAATTGAGCGGAACCCAACAGATAGCATTGTTTGCCACTGGTGCCATATGGACTAGATGGGCC
GGGTTTGTTATAAAACCAAGGAACATGCTTTTGGCATCAGTGAATTTCTTTTTGGGTGGAGTTGCTGGT
TACCAATTGTTAAGAATTGTCAACTACAGAAGAGATTTGGGTGATTCCCCAATGCAAGTATTTAATTAT
ATCTTGAACGGTGATGCAGCTGCTGTAAAAGAACCAGAACCAGCCAAGAATTAA YGR243W_homolog 132aa(SEQ ID NO 488)
MASTVQHASKFQRFLNSETGPRTVHFWAPVFKWALVAAGLNDIQRPVEKLSGTQQIALFATGAIWTRWA
GFVIKPRNMLLASVNFFLGGVAGYQLLRIVNYRRDLGDSPMQVFNYILNGDAAAVKEPEPAKN YHL021C_homolog 1224bp public: 1..1224(SEQ ID NO 489)
ATGTTAAGACAACCATTACGCCAAATCCGTTTCCACTCGAAATTGGCACTTGCAGGATACAACAGCAAA
GAAGTGACAGTCACCATCAACGGCAGAACCTGTACATTCAACAACGTGTTTTTGAGAGACGCATGCCAA
AGCCCAGACTCGGTAGACCCCATTTCTAGCCAAAAACTATTCACTACAGCAGATGCAGCAACCGGCTTG
CAAATTAACGCACCCCCAGTGGTAGAGGATTCCTCATTGAAAATCCAATGGAGCAACAATGGCAAACTC
ACCAACTCAGTCTACCCCGTGTCATTCTTAGAAAACTACTCCACCAACAAACGACTCGGCAAATTCTTT
GACAAAGATAGAAAGTTATGGGACAAACAAGAACTCGAAAACAACTTTGCCTCCCTCAACATGGACTAC
GACGACATTCTCACCAACGACAACTCTTTCTTCCAGACGTTGTACAACTTGAATAGGTACGGGTTAACA
TTTGTCAACAACATCCCCACCCCACAAATTTCTGACATGACAGAGGACAACGCCACGCAATGGCCAGTG
TACAAGATCGCCGAAAAGTTTGGCTACATCAAGAAAACATTCTACGGGACATTATTCGACGTCAAGAAC
AAGAAGGAAAAAGCAACCAACATTGCCTACACCAACACGTTTTTGCCATTGCACATGGACTTGCTCTAC
TACGAGTCCACCCCCGGGATTACAGTTGCTACACGCTATCCAGAACTCTACGTTGGGCGGCGAAAACATC
TTCTGTGACTCGTACCTTGCTGCTGAGCATGTCCGGAAAACCGACCCCAGGGCATACACGGCACTCACC
CAGACCCCAATCACCTTCCACTACGACAACAACAACGAGTACTACTACTACAAGCGGCCGTTAATCGTT
GAAGACCCCGAGGTTGGCGACGGGTTCCCGAAAATCGCGTCCATCAACTATGCCCCGCCATTCCAGGGC
CCATTCGAGGTTGACCCCCACCCAGACTTTATCCGCGGAATGCAGTTATTCGAAACCTTCATCAACGAC
CCGGCAAACCACTTTGAAATCAAAATGCCAGAAGGCACTTGTGTCATTTTCGAAAACAGAAGAGCCCTT
CACTCGAGAAACGCATTCTCCGACCTGAACAACGGCGACAGATGGTTAATGGGCACTTATGTTGACGGC
GACAGTTTTAGATCAAAATTACGTATAGGCTATAGAAAAGTACATACCTAA YHL021C_homolog 407aa(SEQ ID NO 490)
MLRQPLRQIRFHSKLALAGYNSKEVTVTINGRTCTFNNVFLRDACQSPDSVDPISSQKLFTTADAATGL
QINAPPVVEDSSLKIQWSNNGKLTNSVYPVSFLENYSTNKRLGKFFDKDRKLWDKQELENNFASLNMDY
DDILTNDNSFFQTLYNLNRYGLTFVNNIPTPQISDMTEDNATQWPVYKIAEKFGYIKKTFYGTLFDVKN
KKEKATNIAYTNTFLPLHMDLLYYESPPGLQLLHAIQNSTLGGENIFCDSYLAAEHVRKTDPRAYTALT
QTPITFHYDNNNEYYYYKRPLIVEDPEVGDGFPKIASINYAPPFQGPFEVDPHPDFIRGMQLFETFIND
PANHFEIKMPEGTCVIFENRRALHSRNAFSDSNNGDRWLMGTYVDGDSFRSKLRIGYRKVHT YHR162W_homolog 354bp public: 1..354(SEQ ID NO 491)
ATGTCATCATTTAAAAAATTCACTGATTTTTTATTTTCAAAACAATCCCTTAGATATGTCTGTACAACT
CATTTTTGGGGTCCAGTATCAAATTTTGGGATTCCTATAGCTGCTATTTTAGATTTGAAAAAAGATCCT
GATTTAATTAGTGGACCAATGACTGGTTCATTAATACTTTATTCTTTAGTGTTTATGAGGTATTCAATG
GCAGTTACTCCTCAAAATTATTTATTATTTGGGTGTCATTTTGTTAATGAATTGGCACAATTGAGTCAA
GGATTTAGATGGGTTAAACATCACTATGATACTTCTTCAAATGATGGTGAAGATACCAAAAAGATAACT
CAAAATTGA YHR162W_homolog 117aa(SEQ ID NO 492)
MSSFKKFTDFLFSKQSLRYVCTTHFWGPVSNFGIPIAAILDLKKDPDLISGPMTGSLILYSLVFMRYSM
AVTPQNYLLFGCHFVNELAQLSQGFRWVKHHYDTSSNDGEDTKKITQN YLR109W_homolog 531bp public: 1..531(SEQ ID NO 493)
ATGACTGACGGTAAATTCCCAACTAACATTGAACCAAAATACATTCCTTATTCTAAAGATCATGCAAGT
TTAACTGCTTGTGCTAATCCAATACCATTGGATTTAAAATCTTTATTTCCAAATAATACTGTTGTTGTC
ACTGCTGTGCCTGGTGCTTTTACCCCAACTTGTACTGAACAACATATCCCTGATTATTTGAAACATTTG
AAAGATTTCAAAGACAAGGGCGTCAAAAAAATCATTGTTTTATCTGCCAATGATCCATTTGTAATGGCA
GCTTGGGCTAAAGCTTTGGGTTATACTGATGAAGAAAATTATGTTATTTTTGCTACTGATCCTAATGCT
TCTATTTCTAAAGAATTGGGTGATGGATTTGTTGCTGATTTGACTCTGGCAGGTATGGGATTAAGATTA
CAAAGATATGCTAGTATTGTTGTTAATGGAGAAATCACTTATTTGGAAACTGAAGATAGTTTGGGATTC
CTGGAAATTTCTAGTGCTGAAACCATTTTAAAGAGAATCCACAATTAA YLR109W_homolog 176aa(SEQ ID NO 494)
MTDGKFPTNIEPKYIPYSKDHASLTACANPIPLDLKSLFPNNTVVVTAVPGAFTPTCTEQHIPDYLKHL
KDFKDKGVKKIIVLSANDPFVMAAWAKALGYTDEENYVIFATDPNASISKELGDGFVADLTSAGMGLRL
QRYASIVVNGEITYLETEDSLGFSEISSAETILKRIHN YLR206W_homolog 879bp public: 1..879(SEQ ID NO 495)
ATGAGAAAACAAAATAACAATTTATTGGATTTGAATGATGAAACACCACCACAACAACCTCAATATTAT
TTAGCAACCGGATTCTATCAACAACAACCACAATTTTATGCCCAGCAACCTCAATCGCAACAATTCCAA
CAATATGATATGTTTGGGAACCCAATACGAGAATCCAATGGACACAGGATTATATAATCAACAGGCCTAT
TATCAACAACCACAACAGCAGCAACAACAGTTTCAACCAAACCAGTTTACTGGTTTTAACTATGGACAA
CCACAACAACCACAAGCGCAACCAGAACCTTTACAACCATTGAAAACAGGATCCAATAATCCATTTGCC
ATGTCTTCTGGGTCAGACAATACCAACAAGCCACCAACTCAATCCTTAAACAGTTTAGCTGAACAGCAA

```
CAACAGCAACAGCAGCAGCAACCACAATTTTTTACTCAGCCAACTACTGCTCCACTCAAACAACAAAAC
ACATCATCATCAAGGTTTAATGAAACTCATGAGTTGAATGATTTATTAACTCAAGGAACTGGATTAGAT
ACATTCGGTAACACTGGAGATACTAGAATCCCACATCAACATACAAAGACACAAAATTTTATAAATTCA
AGTGGAACTGGATATAAACAAACTGGTAATGAACCAATTAGATTAAGTTCTAATGCTACAGGTAATCCA
TTTCTTAATACTGGTATTGGATATCAAGGTGCTACACAACAGCAAGTGCCACAACAGCAAGTGCCACAA
ATCAATCCTGCTTATACTGGGTATGGATTTGGTAACGCTCAACCTCAACAACACCAGCAATACCAACAA
CAACAACAATCACGTAATGGTAATGATGGCCCAAGTTTAATAGATATTTAA

YLR206W_homolog 292aa(SEQ ID NO 496)
MRKQNNNLLDLNDETPPQQPQYYLATGFYQQQPQFYAQQPQSQQFQQYDMFGNPIQNPMDTGLYNQQAY
YQQPQQQQQQFQPNQFTGFNYGQPQQPQAQPEPLQPLKTGSNNPFAMSSGSDNTNKPPTQSLNSLAEQQ
QQQQQQQPQFFTQPTTAPLKQQNTSSSRFNETHELNDLLTQGTGLDTFGNTGDTRIPHQHTKTQNFINS
SGTGYKQTGNEPIRLSSNATGNPFLNTGIGYQGATQQQVPQQQVPQINPAYTGYGFGNAQPQQHQQYQQ
QQQSRNGNDGPSLIDI YMR043W_homolog 789bp public: 1..789(SEQ ID NO 497)
ATGGCTATTAAAGAAGAAACAAATGAATTTAGTCAAGGTAATGAGGGGAATTCCCATTCAACCAATAAC
AACAATAACAGCAACAACAGCAACAGCAACAACAATGCTGATGTTTCTGCACCAGTAGATGATGACGAT
GATGACGATGGTACTTCTCAAGGTAAAACTCAAAAGGAAAGAAGAAAAATTGAGATCAAATTCATTCAA
GAAAAATCAAGACGTCATATTACTTTTTCGAAAAGAAAAGCTGGGATTATGAAGAAAGCTTATGAATTA
TCAGTATTGACAGGTACTCAAGTGTTATTATTAGTTGTTTCAGAAACTGGTTTGGTTTATACTTTTACC
ACTCCTAAATTACAACCTTTGGTCACTAAATCTGAAGGGAAGAATTTGATTCAAGCATGTTTGAATGCT
CCTGAAGAAGGATTGGGTGATGATCAAGAGAATCAAAGTGATGGAAATACAGGAGATTCACCTGATCAA
AGCCCTGCTCCAGCAACCAATCCAAATGTCATGGGTGCTGCAGGTCATGCTCATCACATTCAACAACAA
CAACAGCAACAACAACAAGCTCAACAGCAAGCTCAGCAACAAATGGCACCAATGCCTTCTCATGGTTTA
CCTACACATTATTCCAATCCTCAAGGAGCTGGTAATCCTGGTGTACCTCCTCAACAACAAGGTCAACAT
CAACCTGGTATTCCATTACAAGGTGGTTATAGTGATCAATACCTGTATTTTGGTAATATTCAAAATAAC
AACATACCTAATCAACAGCAATATCAATGA YMR043W_homolog 262aa(SEQ ID NO 498)
MAIKEETNEFSQGNEGNSHSTNNNNNSNNSNSNNNADVSAPVDDDDDDGTSQGKTQKERRKIEIKFIQ
EKSRRHITFSKRKAGIMKKAYELSVLTGTQVLLLVVSETGLVYTFTTPKLQPLVTKSEGKNLIQACLNA
PEEGLGDDQENQSDGNTGDSPDQSPAPATNPNVMGAAGHAHHIQQQQQQQQQAQQQAQQQMAPMPSHGL
PTHYSNPQGAGNPGVPPQQQGQHQPGIPLQGGYSDQYSYFGNIQNNNIPNQQQYQ YMR256C_homolog 330bp public: 1..330(SEQ ID NO 499)
ATGAGAATGAAACAACCAGACGACCAAAAGTCTGAGAGAGAGAGAGAGAAAAAATATCGGCTCATTATT
TTCAATTCACTTTTAATCCTAGTTAATACTATTTACTTTCTTTCTTCTAACTATCCATCCCACCATCCT
ATCTATTCAATTATGAATCCACAAAGAATTATTGAATTACAAAAACATTATCAAAATACTCCTAAACCA
TTATGGTTAAGAGGTAGACAATCGGCATTTTTAGTTTATCCATTTTATGCTTTATTTGCTGTTAGTACT
GCCATCCCATTATATTATAGTGTTAGAGCTGTTGCTGGTATAAAAGATGAATAA YMR256C_homolog 109aa(SEQ ID NO 500)
MRMKQPDDQKSEREREKKYRLIIFNSLLILVNTIYFLSSNYPSHHPIYSIMNPQRIIELQKHYQNTPKP
LWLRGRQSAFLVYPFYALFAVSTAIPLYYSVRAVAGIKDE YOR267C_homolog 2091bp public: 1..2091(SEQ ID NO 501)
ATGCCAGATAAACATAAACTCAAACTATTTGGAAAAAATAAACACGACAAAGATGACGAATTGTCCTTG
TCAACGTCAAACCATTCTCACGGAAGTACACGGAAGTTTTTAGGATTTCATATTGGAAGACATGAATCG
GGCGACTCGTTGACTTCTCCAGTTATGAGCAATTCATCCGAAAGTCATCATCACAGCCATCACCCTCAT
CAAGCCAATTCAAGTGCAAACCATCGTAACCCTTCTCCAGTTCATTCCAATACTGGTACTGCCACTACC
ATTCCATCAATACAATCACCACAACCTCAACATCATCGTCGGATTACACCGCGGGACTCCGATAAAAAATCA
TCTGGCTCAGTTGTTGATTTGAAAAAATTCTTCAAAACAAAGAAAACTTCAAATCCAAGAAAGGAAGGA
CATAGTATTTTGGGACAATATAGCAATCAGCTCCATTCACCACCACCAATGGCGCAGGTTCATTCGCCT
GGTGCAGGGTCGGGGAACGGCAGTGCCTTGCAATCACGTGAACAATCATCTACGTCATTAGCCACTTTA
ATCAATCAAACATCTTCTCAACTTTTGTACAATGCTTCACATTCTGTCAATAGCAATCGAGATCCCTTC
ACGGACGACAACTCTCCATTGGTGAAGAAGTATGGTAAGATCGGGAAAGAGTTGGGCAGTGGAGCCGGT
GGGTCCGTCAAATTAATCACCAGGCCCAGTGACTCCAAGACGTTTGCTGTTAAAGAATTTAGAGCGAAA
AGATCTACTGAATCATTGAAGGATTACACTAGGAAATGTACTGCTGAGTATTGTATTGGTTCTACTTTG
AGGCACCCAAACATCATTAAAACCATCGATATTATCCATGAAAACAATCGTTATTTTGAAATTATGGAA
TATGCACCTATAGATTTCTTTGCTGTTGTTATGAGTGGAGAGATGTCTCGAACGGAAATCAATTGTTGT
TTAAAGCAAATTATTGAAGGTGTGGCATATTTACACAAATTAGGGTTGGCCCATCGTGATTTGAAATTG
GATAATTGTGTTATAACGAATGAAGGGATTTTGAAGATTATCGATTTTGGTAGTGCTGTCATTTTCAAG
```

```
TATCCCTACGAACAGTTTGGTAACAACAATTCTATTCAGCCGTGTCATGGTATTGTTGGATCTGATCCT
TACTTGGCCCCGAGGTTTTGAAATCTCCTAATAGCTACAACCCACAACCTGTGGATTTATGGTCTATT
GCCATAATTTACTGTTGTATGACTTTGAAGAGATTTCCTTGGAAAATACCTAGTCAAGAAAAGGATAAC
AGTTTCCGACTTTATTGCATGTATGATGATAATTTCCATGATTATTATTTGAGTAACGAATGTCATAAA
CTTTTGTTGCAACAGCGTAAACTAAAGAATACAATTGTTAGACTGAACAAAAGGAAAAAGCAGCTAGAA
GAGGAAAAGGGCGACAAGCCTGAAGAAGACGAAGAAATGAAAGATGCCGATAGTGCACCACAGCAACAT
CATCATTCTCATGATGTAGAGCTGGGAAAAACTGGTGGATCTACGGTTGGCAAAGACAAGTCAAATGAA
GCTGTTACCGTTTTAACAGATGAGCAAGCAGAAGAGATTATGGCACAATTAAATGAGATTGATAGAAAA
CTACAAGAGTTTGAAGATAAAAAGAATCAACTTAAAGAGAAATATGAGGCTTTGCGAGATGCTGATCCT
AGATATCAAAAACAGTTGGCACAAATTCACGAAGAGGAAGAAAAGCAAAGACTAAAAGATGCCGAGCAC
GGTGCCGATGAGAAAAAGAAATCACATCATAAACAGATTCGATGGTCCGTATAGATTGATGAGATTGTTG
CCACATGCTGCTAGACCAGTCATATCAAGATTATTGGAGGTTGATCCAAAGAAAAGAGCAACTATGGAA
GAAATTCTAGAAGATGAATGGATTAAAGAAATTCAATGCTGTACAGTTAAGCCAGTTTCAAAATCAACA
GATGCAACATTAGATTTTATTGAGGATGAGGACGAAGTATTGGTGAAAGGAGTACCTCCACACGAGCAT
ACAATTGTGAAAGAAGGTTGA

YOR267C_homolog 696aa(SEQ ID NO 502)
MPDKHKLKLFGKNKHDKDDELSLSTSNHSHGSTRKFLGFHIGRHESGDSLTSPVMSNSSESHHHSHHPH
QANSSANHRNPSPVHSNTGTATTIPSIQSPQPQASGLHRGDSDKKSSGSVVDLKKFFKTKKTSNPRKEG
HSILGQYSNQLHSPPPMAQVHSPGAGSGNGSALQSREQSSTSLATLINQTSSQLLYNASHSVNSNRDPF
TDDNSPLVKKYGKIGKELGSGAGGSVKLITRPSDSKTFAVKEFRAKRSTESLKDYTRKCTAEYCIGSTL
RHPNIIKTIDIIHENNRYFEIMEYAPIDFFAVVMSGEMSRTEINCCLKQIIEGVAYLHKLGLAHRDLKL
DNCVITNEGILKIIDFGSAVIFKYPYEQFGNNNSIQPCHGIVGSDPYLAPEVLKSPNSYNPQPVDLWSI
AIIYCCMTLKRFPWKIPSQEKDNSFRLYCMYDDNFHDYYLSNECHKLLLQQRKLKNTIVRSNKRKKQLE
EEKGDKPEEDEEMKDADSAPQQHHHSHDVESGKTGGSTVGKDKSNEAVTVLTDEQAEEIMAQLNEIDRK
LQEFEDKKNQLKEKYEALRDADPRYQKQLAQIHEEEEKQRLKDAEHGADEKKKSHHKQIHGPYRLMRLL
PHAARPVISRLLEVDPKKRATMEEILEDEWIKEIQCCTVKPVSKSTDATLDFIEDEDEVLVKGVPPHEH
TIVKEG YOR374W_homolog 1500bp public: 1..1500(SEQ ID NO 503)
ATGTTTAAAAAGGCCTTACCATTAGTCAGCAAGCTCACAACACCAAAAGGTATCACTTATAACCAACCC
CTTGGGTTATTCATCAATAACGAATATGTTCACCCAAAGCAACAAAAGACATTTGAAGTTATTTCTCCA
TCCACTGAAGAAAAATAACTGATGTTTACGAAGCTTTAGAAGAAGATATTGATACTGCTGTTGAAGCC
GCACAAGCCGCATACCACAATGGTTGGGCTCAAGGGCCACCAGAACAAAGATCAAAAGTTTTGTTCAAA
TTAGCCGACTTGATTGAAGAAAATGCCGAATTATTAGCTCAAATTGAAACTTGGGACAACGGTAAATCC
TTACAAAATGCCAGAGGTGATGTTGCCTTGACAGCTGCTTACTTCAGATCCTGTGGTGGTTGGGCCGAC
AAAATTTTGGGTTCCCAAATCAATACTGGTAACACTCATTTCAACTACACTCAAAGAGTCCCATTAGTC
TGTGGTCAAATTATTCCTTGGAATTTCCCATTATTGATGGCTTCTTGGAAATTGGGACCAGTTCTTGCT
ACTGGTTCTACCACTGTTTTGAAGACTGCTGAATCCACCCCATTATCTGCTTTATATCTTTCCCAATTG
TTAGTCGAAGCCGGTATGCCAAAAGGTGTTATCAACATTGTTTCTGGTTTTGGTGCTACTGCTGGTGCT
GCCATTGCTAAACATCCAAAGATTGAAAAAGTTGCTTTCACTGGTTCTACTGCCACCGGTAAAATTATC
ATGAAATTGGCTGCTGAATCAAACTTGAAAAAAGTTACTTTGGAATTGGGTGGTAAATCTCCAAACATT
GTTTTCAACGATGCTGATTTGGACAAGACTATTCAAAACTTGATTGTTTCTATCTTCTACAATTCTGGT
GAAGTCTGTTGTGCTGGTTCTCGTCTTTTGATTCAATCCGGTGTTTACGACCAAGTTGTTGAAAAATTC
AAAGAAGCTGCTGAAAGTGTCAAGGTTGGTAACCCATTCGACGAAGACACTTTTATGGGTGCCCAAGTT
TCTGACGTCCAATTGTCCAAAATTTTGAAATACGTTGAATCTGGTAAATCTCAAGGTGCTACTGTTGTT
ACCGGTGGTGCTAGAGCTGATGGTAAAGGTTACTTTGTCAAACCAACTATTTTCGCTGATGTCAAGAAA
GATATGGATATTGTCAGAGAAGAGATCTTTGGTCCAGTTGTCACTTTGATCAAATTTGATACTGTTGAC
GAAGCCGTTGAATTGGCCAATGATTCCGATTATGGTTTGGCTGCTGGTATTCACTCTGCTGACGTTAAC
AAATGTATTGATGTGGCCAACAGAGTTAAAGCCGGTACTGTTTGGGTCAACACTTATAACGATTTCCAC
CCAATGGTTCCATTCGGAGGATTCAGTGCTTCAGGTATCGGTAGAGAAATGGGTGAAGAAGTTTTGCAT
GAATACACTCAAGTCAGAGCTGTGAGAATGAAAATCAACCCACCAAACTAA YOR374W_homolog 499aa(SEQ ID NO 504)
MFKKALPLVSKLTTPKGITYNQPLGLFINNEYVHPKQQKTFEVISPSTEEKITDVYEALEEDIDTAVEA
AQAAYHNGWAQGPPEQRSKVLFKLADLIEENAELLAQIETWDNGKSLQNARGDVALTAAYFRSCGGWAD
KILGSQINTGNTHFNYTQRVPLVCGQIIPWNFPLLMASWKLGPVLATGSTTVLKTAESTPLSALYLSQL
LVEAGMPKGVINIVSGFGATAGAAIAKHPKIEKVAFTGSTATGKIIMKLAAESNLKKVTLELGGKSPNI
VFNDADLDKTIQNLIVSIFYNSGEVCCAGSRLLIQSGVYDQVVEKFKEAAESVKVGNPFDEDTFMGAQV
SDVQLSKILKYVESGKSQGATVVTGGARADGKGYFVKPTIFADVKKDMDIVREEIFGPVVTLIKFDTVD
EAVELANDSDYGLAAGIHSADVNKCIDVANRVKAGTVWVNTYNDFHPMVPFGGFSASGIGREMGEEVLH
EYTQVRAVRMKINPPN
```

YPL089C_homolog 1836bp public: 1..1836(SEQ ID NO 505)
ATGGGTAGAAGAAAGATTGAAATAGAACCATTGACAGACGATAGAAATCGTACAGTGACTTTTGTGAAG
CGTAAGGCAGGGTTATTTAAAAAAGCTCATGAATTAGCTGTGCTCTGTCAAGTGGATTTAACGGTTATT
ATCGTTGGCAATAATAATAAAGTATATGAATATTCTACTGTTGAGGCAAATGAGATTTTTAATGCCTAT
AATAAAACCATTAAAGTCAGAAAACAAGTACATGAATCGAAGTCTCCAGAATATTATTCGAAATTTAGA
AAGAAACGACATTTAAATGAACCACTTATGAATAAATCAGGGTCTGTAGTTGGCACTAATACACATTTG
AACGATGAAGACTATGATCATAATGTTCATGAAGCGGGCGATGAGGATTCGGAATATGAAAGCGATGAT
AATTCTCCACAACCTAAACGGCACAAAAGATCAGAGTCGGTTAAAAAAGAGCAAAACCCCAAAGTGTTT
AATAGTACCCAACCTCCACCACCGCCTCCACCACCTCATATATCTTTAAATAATGTTCCAACATTTACC
AACCCCCAAAATTACAAAAAACAGATTGATGAGACAAATAACACTTCGGCACCGCCCGCTACTGGGACA
AAAAATGAACCAACGATGCAACGACCAGTATTGAGGGTACAAATACCGAATGATGCCAAGAGCAATACG
AATAATTCCCATAGTGGTGTTAATAATAGTGATGGCAAGGACACGGCGAGAACAGTGACGGCAGTCGAC
AATAGTGCAACCAACCAAAACACTCAATCGAGCAATACAACATCAGGTACAGGGACTGCTGATACCAAT
TCATCGCAACTAAATTCAAATGGTAATAGTAATTTAGTGCCCGGGAATGTTCCAAATACCAGATTTTCG
GGATATTCATCGTTTCGATCACCAGACTCACGAAAACCAACATTACCGTTACCTTTGCAAACCAAATCA
CAAACGTCATCTCCAGCTAGTGCTGTAGCACCAGGTTTACCATTGACAGGAGGAAGCAATGCATATTTT
GCAGGAATGCAACAATCACCCGTGGGTGGTTCGTATGTCAATTATCCAGCCCAAGTATATCAGCAGTAT
CAACAGTTCCAAAATCAACTACAACTACAAGAACAACAACAGCAACAGCAACAGCAACAGCAAAAACAA
CAATCTCAGCCGCAGCCATCATCGCAACTGGTTGGAAATCAAAATGCACAATTGGAATCAGCAGCACGA
TTCCGTTCTGGTTTACCGACAGGGGACACAATTTAATAATGGTGAACAAACACCAATTTCAGGATTGCCA
TCACGATACGTTAATGATATGTTCCCCTTCCCATCTCCATCAAACTTTCTTGCACCTCAAGATTGGCCA
TCAGGTATAACACCAACTACTCATCTACCACAGTATTTTGTGAATATGCCATTGAGTGGAATTGGACTG
CAACAACTGCAACAACAACAACAACAACAACAACAACAACAACAACAACAACAACAACAACAACAACAA
CAACAACAACAACAACAACAACAACAACAACAACAGCAACAACAGCAACAACAGCAGCAGAATGCC
CAACAGCAACTGCAAGTACCTGTTATCCCAATACAAACACAAACATCACAACAAATGGCTTCAACTACC
AATCACAAATCAGCTAATCTAATACCAGGGTTTTTACAAACCCAACACAAGCCACTGGAAATTCGGCA
AATGCTTCCAAGCTGAGTGATGCTGGTGATGGTACTAATCCAACCACAGCAGGAAGTTCAAGTTCAGCA
GATGTCAATAACACCAACAATGGACCTAATAAAAATACATAA YPL089C_homolog 611aa(SEQ ID NO 506)
MGRRKIEIEPLTDDRNRTVTFVKRKAGLFKKAHELAVLCQVDLTVIIVGNNNKVYEYSTVEANEIFNAY
NKTIKVRKQVHESKSPEYYSKFRKKRHLNEPLMNKSGSVVGTNTHLNDEDYDHNVHEAGDEDSEYESDD
NSPQPKRHKRSESVKKEQNPKVFNSTQPPPPPPPHISLNNVPTFTNPQNYKKQIDETNNTSAPPATGT
KNEPTMQRPVLRVQIPNDAKSNTNNSHSGVNNSDGKDTARTVTAVDNSATNQNTQSSNTTSGTGTADTN
SSQLNSNGNSNLVPGNVPNTRFSGYSSFRSPDSRKPTLPLPLQTKSQTSSPASAVAPGLPLTGGSNAYF
AGMQQSPVGGSYVNYPAQVYQQYQQFQNQLQLQEQQQQQQQQQQKQQSQPQPSSQSVGNQNAQLESAAR
FRSGLPTGTQFNNGEQTPISGLPSRYVNDMFPFPSPSNFLAPQDWPSGITPTTHLPQYFVNMPLSGIGS
QQSQQQQQQQQQQQQQQQQQQQQQQQQQQQQQQQQQQQNAQQQSQVPVIPIQTQTSQQMASTT
NHKSANLIPGFLQNPTQATGNSANASKSSDAGDGTNPTTAGSSSSADVNNTNNGPNKNT YAL003W_homolog 693bp public: 1..693(SEQ ID NO 507)
ATGAGTGACAAGAAGATTTAAATCTTATATCTGACAATAATAGAGTTATTTCAATGAGACAATTGATT
TTACAATTACTGACTACAGGAATAAACAAAAAATATAAACGATATACTAACATGTTTGATAGTACTACT
GCCACTCAAGCTGATGTCACTGTCTACAAAGCTTTCCAAAAGGAATTCCCACAATTCACCAGATGGTTC
AACCACATTGCTTCATTCACTGAAGAATTCGAAGACTTGCCAGCCGGTAAAGCCCCAGCCGCTTCTGGT
TCTGCTGCTGCCGCTGCTGAAGAAGAAGATGACGAAGATGTCGACTTGTTCGGTTCTGATGATGAAGTT
GATGAAGAAGCTGAAAAATTGAAGCAACAAAGATTAGCTGAATACGCTGCTAAGAAGGCTGCTAAAGGT
CCAAAACCAGCTGCCAAATCTATTGTCACCTTGGATGTCAAACCATGGGATGATGAAACTGATTTGGAT
GAATTATTGACCAACGTCAAAGCTATCGAAATGGAAGGTTTGACTTGGGGTGCTCACCAATGGATTCCA
GTTGGTTTCGGTATTAAAAAATTACAAATTAACTTGGTTGTTGAAGATGCTTTAGTCTCATTGGATGAC
TTACAAGCTGCTGTTGAAGAAGATGAAGACCACGTCCAATCTACTGATATTGCTGCTATGCAAAAATTG
TAA YAL003W_homolog 230aa(SEQ ID NO 508)
MSDKEDLNLISDNNRVISMRQLILQLSTTGINKKYKRYTNMFDSTTATQADVTVYKAFQKEFPQFTRWF
NHIASFTEEFEDLPAGKAPAASGSAAAAAEEEDDEDVDLFGSDDEVDEEAEKLKQQRLAEYAAKKAAKG
PKPAAKSIVTLDVKPWDDETDLDELLTNVKAIEMEGLTWGAHQWIPVGFGIKKLQINLVVEDALVSLDD
LQAAVEEDEDHVQSTDIAAMQKL YAL060W_homolog 1185bp public: 1..1185(SEQ ID NO 509)
ATGAAGGCAATTGTATACCACGATAGAGGAGATATTAGATACGACCCCAATTTCCCTGATCCACAAATC
ATTCGACTGGATGATGTCAAAATCAAAGTTCATTATTGTGGGATTTGCGGTACTGATTTAAAAGAATAT
AGTGATGGGCCGATTTTTTTCCCACCGAAAGGTGAATTGAATGAAATTTCTCAAATGGAATCAATTCAA

```
GTCATGGGTCATGAAATTAGTGGTGAAGTAATTGCTATTGGGGATGATGTAACCAATGTTAAAGTGGGT
GATAAAGTTGTTGTTGAAGTGACAGGAACTTGTTTAGATAGACATCGTTACCAAGATCCTAAAAATGGC
GATCTGCCTAAACCAAATTGTCCAAGTTGTGTTTCGGGTAACTATAATGCGTGTGATTATCTTGCTTTA
ATTGGTTGTGGATTTGCTAATGGTGGATGTGCAGAATATTTAGTTGTTGCTAGTCTGAAAGTTATTGCA
TTCGATCAGAATAAAATCCCTATGGATATTGCCGCATTAATTCAACCAATAGCTGTTAGTTGGCATGCT
GTTAAAGTATCAAATTTTAAACCCGGTTCTAATGCATTAATTTTAGGTGGTGGCCCCATTGGATTAACA
ACAATTTTTGCTTTGAAAGGTAATCAAGTCTCCCAAATTGTTTTAAGTGAACCAGCATTAGCAAGACGT
CAATTGGCAGAGAAATTAGGAGTTATTACTTATGACCCTACGGGTAAATCAATCGAACAATGTGTTGAA
GACTTAAAAAAATTATCCCCGGGAGGTTATGGTTATGAATATTCATATGATTGTTCTGGAGTTAAGGCA
ACTTTTGAAACTGGATTGAAAACTTTGAAAATTCGTGGATGTGCAACAAATGTTGCCATTTGGGCTCAT
AAATCAATTCCATTATATCCTATGGAAATTACCCTTTCAGAAAAAATGTTAACTGGATCAATTTGTTTT
GTTAAAAAAGATTTTGAAGAATCAATTAAAGCAATTGAAAATGGTTTAATATCGATTGATGAATTGAAA
ATGTTGATTACTCTGAAAATTCATTTACAAGATGGAATTGAAAAGGGTTTTTGGAATTAATTAATCAC
AAGGAAAAACATATTAAAATATTGTTTTCTCCGAAAAGTGAATATTTACTATGCAATGGAGTAAATGAT
TCCAATAAATAA

YAL060W_homolog 394aa(SEQ ID NO 510)
MKAIVYHDRGDIRYDPNFPDPQIIRSDDVKIKVHYCGICGTDLKEYSDGPIFFPPKGELNEISQMESIQ
VMGHEISGEVIAIGDDVTNVKVGDKVVVEVTGTCLDRHRYQDPKNGDSPKPNCPSCVSGNYNACDYLAL
IGCGFANGGCAEYLVVASSKVIAFDQNKIPMDIAALIQPIAVSWHAVKVSNFKPGSNALILGGGPIGLT
TIFALKGNQVSQIVLSEPALARRQLAEKLGVITYDPTGKSIEQCVEDLKKLSPGGYGYEYSYDCSGVKA
TFETGLKTLKIRGCATNVAIWAHKSIPLYPMEITLSEKMLTGSICFVKKDFEESIKAIENGLISIDELK
MLITSKIHLQDGIEKGFLELINHKEKHIKILFSPKSEYLLCNGVNDSNK YBL058W_homolog 1116bp public: 1..1116(SEQ ID NO 511)
ATGTCTGAAAATACTCCAGATTCCCAATTGATTGCTGAATTTGTATCTATAACAAATTCTTCTACATAC
CTTGCTGAACAGTATTTACTGAGAAACAGCAATGATTTAGTGGAAGCAGTTGAGGATTTCTATGCCAAC
AATGAACCATCTCAAAAATCAGAAACCAAAAAATCTTCTTCTTCTAATGCTAAAGGCTCTGGTGTTAAA
ACATTTAGAGACTTGAACGATGAAGATGATGATGAAGAGGATGACAAGACCAATACCAATTTCTTTACT
GGAGGAGAGAAATCAGGATTGCAAGTTGAAGATCCCAATAAAGATAAGGATAATGACAGATCAATAATT
GATCAAATTTTCCAAAAAGCCAGAGAACAAATGCAACAACCAGATGATAGACCAAGTGCTTCTCAAGAT
GATCAACCATCACCAATTAAATTTTCAGGCAAAGGGTTCAAATTGGGTGACGGGAATGAACCAAGTCAA
GTAGTGCAGGATCCTAATGCCAGTGCTAAAAAATTCAGACCTAGTAAAGTGACTAGAGAAATTACATTT
TGGAAACAAGGTTTCACAGTAGGTGATGGACCTTTGCATAGATACGATGATCCAAGAAACGCCAGTGTT
TTGCAAGAATTGAACCAAGGAAGAGTTCCAATGTCAATTTTAGATGTTGAATTTGGCCAAGATGTTGAT
GTTTCTGTATACAAGAAAACCGACGAAGATTGGACACCTCCGAAAAGAAAAATTGGTGGTTATCACGGT
GCAGGTCATAGACTAGGCTCACCAGTACCTGGGGAAGTACTTGTAAATAATGAAGCATCATCTCAACCT
GATATCAAAACCGAAACTGAAATTTCTAAACCAAAAGACGAAGGCGAAGGTGACTCCACAGTTCAAATA
AGATTTGCCAATGGTAAAAGAACATCACACAAATTCAATTCCTCGGATTCTATTCTCAAGGTTTATGAA
TTTGTTAAAAATCATGAATATAATTCTGAACCTACTAGACCATTCACTTTAAGTCATGCATTCCCAGTC
AAACCAATAGAAGAAAGTAGTGACATTACAATTTCTGATGCTAAATTGAAAAATGCAGTGATTGTTCAA
AGATGGAAATAG YBL058W_homolog 371aa(SEQ ID NO 512)
MSENTPDSQLIAEFVSITNSSTYLAEQYLSRNSNDLVEAVEDFYANNEPSQKSETKKSSSSNAKGSGVK
TFRDLNDEDDDEEDDKTNTNFFTGGEKSGLQVEDPNKDKDNDRSIIDQIFQKAREQMQQPDDRPSASQD
DQPSPIKFSGKGFKLGDGNEPSQVVEDPNASAKKFRPSKVTREITFWKQGFTVGDGPLHRYDDPRNASV
LQELNQGRVPMSILDVEFGQDVDVSVYKKTDEDWTPPKRKIGGYHGAGHRLGSPVPGEVLVNNEASSQP
DIKTETEISKPKDEGEGDSTVQIRFANGKRTSHKFNSSDSILKVYEFVKNHEYNSEPTRPFTLSHAFPV
KPIEESSDITISDAKLKNAVIVQRWK YBR039W_homolog 804bp public: 1..804(SEQ ID NO 513)
ATGCGTCTTAAATCCATTAAAAACATTGAAAAAATCACCAATACCATGAAGATTGTTGCCTCTACTAGA
TTGAGTAAAGCTCAAAAAGCCATGGCTTCATCTCGTGTTTTCAATGAAACTGATAAAGAATTCTTGTCT
AATGCTGAACCAAAACCAATTGAAGAAGAAGCTTCTAAATCTGATGACAAAACTTTATTGATTGTTGTT
TCTTCCGATAAAGGTTTATGTGGTTCTATTCATTCTCAAGTTTCCAAAGCTGCCAGAAAGAGAACTGAA
GAATTAAATGGTAATGTCGATATTGTTTGTATTGGTGATAAAGTCAAAGCACAAATTTGAGAACTTAT
GCTGACAAAGTTAAATTGGCATTCAATGGTGTTGGTAAGAAGAACCAAATTTCACTGAAGTTGCCTTA
ATTGCTGATGAAATTGCTAAATTAGGTAACTATGAAAATGTTGAAATTCTTTACAACAAATTTGTTTCT
GGTGTTTCATTTGAACCATCTAAATTTTCCATTTATGCTGCTGATGCCATTGCTAACTCTCCAGGTTTA
AGCAAATATGAATTGGAAAATGAAGAAATCACTTCTGATGTTGCTCAATTCTCTTTAGCTAACAACTTG
TTGACTGCTATGGCTGAAGGTTATGCATCTGAAGTTTCTGCTAGAAGAAATGCTATGGACAATGCCTCC
```

AAGAATGCTGGTGATATGATCAACAGTTACTCTATTTTGTATAACAGAACTAGACAAGCCGTCATTACC
AACGAATTGGTTGATATCATTACTGGTGCTTCCTCATTGGACTAG

YBR039W_homolog 267aa(SEQ ID NO 514)
MRLKSIKNIEKITNTMKIVASTRLSKAQKAMASSRVFNETDKEFLSNAEPKPIEEEASKSDDKTLLIVV
SSDKGLCGSIHSQVSKAARKRTEELNGNVDIVCIGDKVKAQILRTYADKVKLAFNGVGKEEPNFTEVAL
IADEIAKLGNYENVEILYNKFVSGVSFEPSKFSIYAADAIANSPGLSKYELENEEITSDVAQFSLANNL
LTAMAEGYASEVSARRNAMDNASKNAGDMINSYSILYNRTRQAVITNELVDIITGASSLD YBR062C_homolog 450bp public: 1..450(SEQ ID NO 515)
ATGTTATCTGCATCTAACGAAGAAGCCATAGCATCAGCATTGCGACAATTGAGTGAATCAGAAGGATCA
ACACTTGCTCAATCACTCATGGATCTGCTTGGTGAACAAAAGACATCGAAGGGGGTCACTGACGAATAC
TTGGATACTTTGGAACGTATTCCAGTAAAACAAATTACTGATAAAGACGCATCTTGTCCAATTTGTACA
AATCGATTCAAAGATGATAAGCATCCATTGATTGTCAGATTGCCTTGTGGTCATGGAGTCAATCATATT
TTTGATTTGGAATGTGTTGGGCCGTGGTTGCAAATGAATTCCACTTGTCCAATGTGTCGAACCAATATC
TTAGAGGTAGAAGCTAATAGAAGGAAAATAATAGATGAAGAAATAAAAAAGGCCCAAGAAGAAGATTCC
GAGGAAGAAGAAGAAGGTTGGGATATATATGGATAA YBR062C_homolog 149aa(SEQ ID NO 516)
MLSASNEEAIASALRQLSESEGSTLAQSLMDSLGEQKTSKGVTDEYLDTLERIPVKQITDKDASCPICT
NRFKDDKHPLIVRLPCGHGVNHIFDLECVGPWLQMNSTCPMCRTNILEVEANRRKIIDEEIKKAQEEDS
EEEEEGWDIYG YBR101C_homolog 855bp public: 1..855(SEQ ID NO 517)
ATGGAAAAATTATTACATTGGACAATTGCACAACAATCAGGGGATAAAGCAGCTCTTGAAAAGATTGGA
GAACCCGATCAAAAGGCACTTAATCAATTATTTGGTGGTCCCGATGAAGCCACTTTAATGAAGGAAAGT
ATAAAAGTTGTTGAATCAACCGATGTTTCATTAGAAGATAAAGAGATCGCCTTGGAAAATTTCGAAATG
TTGATTGAAAATTTAGATAATGCAAATAATATTGGTAATTTGAAATTATGGAATCCATTGATTGACATT
TTAGCCAAAGAAGATACCCCTGTTGAATTGAAAGTACTTATTTGTGGAATAATTGGAACCGCTGTACAA
AACAACCCCAAATCTCAAGAAGATTTCAATGAAACTGAAGGATTGAGTGAATTGATAGAATTAGCACAA
GATGACAAAAAATTTGAATTACAACTGAAGGCATTGTTTGCTATTTCTTCATTTATCAGAAATTTTCAA
CCTGGATATGCAAAGTTTGAGAAATTGCAAGGTTTGAAACTCATTAATTTTGATAACAAGAACAACAAG
TATCAATTGAGAATTTTATCATTAATATCATCCATTTTGAGTAATGGGTTAGACGATAGCTTGAAAGCA
CAATTCAAAGAAGCAAAATTACCTCACTATTTAGCCTCGGTATTGAATGAGGATTCAAACACTAGTTTG
GTGGACAAATCTTTAAACATTGTTTCTCAATTGAATCAATTAAACTATGAGTTTAGCTTAGAAGAAAAA
TATGAAATAAATAGAGGAATCCAAGTGGTTGAAGGGTTGAGTGAGAAACTTAATATTGATGATCTCAAT
AATGCCAAACAGGCCACATCCTCTTAG YBR101C_homolog 284aa(SEQ ID NO 518)
MEKLLHWTIAQQSGDKAALEKIGEPDQKALNQLFGGPDEATLMKESIKVVESTDVSLEDKEIALENFEM
LIENLDNANNIGNLKLWNPLIDILAKEDTPVELKVLICGIIGTAVQNNPKSQEDFNETEGLSELIELAQ
DDKKFELQSKALFAISSFIRNFQPGYAKFEKLQGLKLINFDNKNNKYQLRILSLISSILSNGLDDSLKA
QFKEAKLPHYLASVLNEDSNTSLVDKSLNIVSQLNQLNYEFSLEEKYEINRGIQVVEGLSEKLNIDDLN
NAKQATSS YBR139W_homolog 1653bp public: 1..1653(SEQ ID NO 519)
ATGCAATTATCTACATTAGTCACTTGGTTGGCTGCTTTAACTGTCGGTGCACAGGCAGTATCATTCGGC
AACAATTTAAAAGATCAGATTATATTGGATTCTGAGGAAAGCTCCCCAGATTTATATTTGGAGTCAGTG
TTCAAAGACTTGGGTTCATTGCCAGTTGATTTGATTACTGCTTGGGCAGAAATGCAATCTGAATTATCA
CCTGAACAAATTGCCAAATTAATCAATCAATATGAAGTCTAAAAATGAAAAACCAAAGAAAAATAAGTTT
AATCCAATGTCGACATTTTCTTCACCAAGTTCCAAGTTTGAAAAGCTTTCCAATGATAAATTTGCTGGT
TATTCAATGCGTGTAAAAGAGAGTTTCCCAGAAATTTTGGGTCTTGATACAGTGAAACAATACACTGGG
TATTTAGATATTGACTCATTAGATAAACATCTTTTCTATTGGTTTTTTGAAAGTAGAAATGATCCAAAG
AATGATCCTATTATTTTATGGCTCAATGGTGGTCCAGGTTGCAGCTCTTCAACGGGATTATTTTTTGAA
TTAGGACCATCCTCGATCAACAAAACTTTACACCCAGTTTACAACCCATATTCTTGGAATTCCAATGCG
TCGGTTATTTCTTAGATCAACCCGTTGGAGTTGGATATTCGTATACAGGAGGAGATGAAGTTAAGAAT
ACTCTCACTGCTGCTAAAGACGTTTATGTGTTTTTGGAATTGTTTTTCCAAAAATTCCCACAATTTTTG
ACTAATAAGTTTCACATTGCCGGTGAATCTTACGCCGGTCATTATATACCAGCATTTGCTTCAGAAATC
ATTAACAATGCCGATAGGTCATTTGAGTTGGCTCTGTGTTGATTGGTAACGGTATCACCGATCCATTG
ATTCAAGATGGTTCCTATAAACCAATGGGCTGTGGTGAAGGTGGTTACAAACCTGTTTTGACAACTGAA
CAGTGTGATCAAATGGAAAGGGATTATCCTAGATGTGCTAAATTGACTAAATTATGTTACAGTTTCCAA
TCTGCCTTGACTTGTGTTCCAGCTCAATACTACTGTGATTCCCGTTTATTTCAACCTTATGCTCAAACA
GGATTAAATCCTTATGATATCAGAAAGGATTGTGCCGAGCAAGGTGGTAATTGTTACGTAGAAATGGAT

```
TACTTGGATGAATACTTGAATCTCGATTATGTGAAAGAAGCTGTTGGTGCTTCTAATATTGACATTTTT
ACTTCATGTGATGACACCGTGTTTAGAAACTTTATTTTAGATGGTGATGAAATGAAACCTTTCCAACAA
TATGTTGCTGAGTTATTGGACAATAATGTACCTGTATTGATTTATGCTGGTGACAAAGATTATATTTGT
AATTGGTTGGGTAACTTGGCATGGGTAAACGAATTGGAATATTCAGATAGTGAACATTTTGCACCAAAA
CCATTACAATTATGGAAACAAGATGGCAAGAAAGCTGCTGGAGAAGTCAAGAATCACAAACATTTTACA
TTCTTGAGAATTTATGACGCTGGTCACATGGTTCCCTTTGATCAACCAGAAAATGCTCTTAGTATGGTT
AATACTTGGGTACAGGGAGATTATTCTTTTGGTTTAGAGGGTAATAAATTATCTGAAGCTGATTAA
```

YBR139W_homolog 550aa(SEQ ID NO 520)
```
MQLSTLVTWLAALTVGAQAVSFGNNLKDQIILDSEESSPDLYLESVFKDLGSLPVDLITAWAEMQSELS
PEQIAKLINQYESKNEKPKKNKFNPMSTFSSPSSKFEKLSNDKFAGYSMRVKESFPEILGLDTVKQYTG
YLDIDSLDKHLFYWFFESRNDPKNDPIILWLNGGPGCSSSTGLFFELGPSSINKTLHPVYNPYSWNSNA
SVIFLDQPVGVGYSYTGGDEVKNTLTAAKDVYVFLELFFQKFPQFLTNKFHIAGESYAGHYIPAFASEI
INNADRSFELASVLIGNGITDPLIQDGSYKPMGCGEGGYKPVLTTEQCDQMERDYPRCAKLTKLCYSFQ
SALTCVPAQYYCDSRLFQPYAQTGLNPYDIRKDCAEQGGNCYVEMDYLDEYLNLDYVKEAVGASNIDIF
TSCDDTVFRNFILDGDEMKPFQQYVAELLDNNVPVLIYAGDKDYICNWLGNLAWVNELEYSDSEHFAPK
PLQLWKQDGKKAAGEVKNHKHFTFLRIYDAGHMVPFDQPENALSMVNTWVQGDYSFGLEGNKLSEAD
```

YCL052C_homolog 1446bp public: 1..1446(SEQ ID NO 521)
```
ATGAGACAAAGAACAACCATTTATAATCCTTATTCTAGTCATGATGGAATCATAACTAATCTTAATCGA
ACAAATTTCCAATTATCAAGCATACCTAATCATTTATTCACAATTGAGAATAAATATACCATCACCACC
ACCACCACACAACCTAACAAATCATCATTATATCTGGCAATTAAAGAATTAAGAATTCAAACGAAATTC
AATAATAATGAATCAGGTATACCAATTTTTTCATTTCATTATGAACCAGGACTTAATATTTATGCTGTA
CCACAATCTAATGTCGACAAATTAGAATTTTGGCAACAAGTTGAACAATTGATAATGGAATTATTAGGG
ATTAAATTATCTTCACAACAATGGATTGCTAATGTTAATTCTTTTTATTATCATGATATTCAACCTCAA
CCATTATTGAATTTGAAAGAAGGATGGAAATTCAATTTACATCCTAAATCCAATTATGATTATATATAT
AATCAAGATAAAATTATTATTCGGGAATTGTTAACAAATGTGTCAGAAATAGAATTTAATCTTGAACTG
GGTATTTATAAAGAAATTGGTTTGTTTTTAATTGATGAAAAAATCTCAACTAATGATGATTTGAATTTA
AGTGGTATTAGAGTGATATTAGATGAAGATAGTAATACTAATAACAAAGAAGAATCGATACATAAGACA
ATGTTTCATATAAAACCAAGACATAGGAGTTTTGATGATTCTACCACCATCACCACCACCAAGATCATT
CCACAAGGATTACATCCTATTTTGAGTACTGAACTTAACACAACAACTATTGTTATTCCAACTGATTTT
GATGTTGAAGAATGTAAATTTTATTATTATTTGAATTTAAATAAATCATTAATATTTGATCAATTTCAA
AACATTCCAATAGGATCGCAATTAATTATTAATAATGGGAATAAAAATTTAGAATTACCAGAATATAAA
ATTAATCAATGGGGTAATGAACTTTTATTTGAATTTGAATTTGATAATGATAATGATATCCCTCATCAT
ATAAATTTAACAGTTCATTCAAGATATCAATTACCTCAAAATAATCATTCCCATTCCCAAATTAGTAAT
GTTTTAAATTCGTTACCAAATATTTTTATAGGTTGTAATGTCAAAGAAGGAAATTTATTAGATAAATCA
CCTTTTGATACTAAAAGAGATGTTAAAATTGGTGGTAATTATGAAATTTATTTTACTGAAGATACAGTT
TTTTATCATTTACAGAATTCCGACAATTCCGGCAATTCCGGTAGTTCAACATTATTAGAAATTAATATT
CCTCATGGGAAAACTACATTTGATAGAGTCAATAATATAACTTCACTTGGTTTATTAATTGGTGTATTG
ATGATTTTATATGCCATTTCAATAAGAGTTTTCATGAGTACCACTTCAAAGACGAAAAGGGATTAA
```

YCL052C_homolog 481aa(SEQ ID NO 522)
```
MRQRTTIYNPYSSHDGIITNLNRTNFQLSSIPNHLFTIENKYTITTTTQPNKSSLYSAIKELRIQTKF
NNNESGIPIFSFHYEPGLNIYAVPQSNVDKLEFWQQVEQLIMELLGIKLSSQQWIANVNSFYYHDIQPQ
PLLNLKEGWKFNLHPKSNYDYIYNQDKIIIRELLTNVSEIEFNLESGIYKEIGLFLIDEKISTNDDLNL
SGIRVILDEDSNTNNKEESIHKTMFHIKPRHRSFDDSTTITTTKIIPQGLHPILSTELNTTTIVIPTDF
DVEECKFYYYLNLNKSLIFDQFQNIPIGSQLIINNGNKNLELPEYKINQWGNELLFEFEFDNDNDIPHH
INLTVHSRYQLPQNNHSHSQISNVLNSLPNIFIGCNVKEGNLLDKSPFDTKRDVKIGGNYEIYFTEDTV
FYHLQNSDNSGNSGSSTLLEINIPHGKTTFDRVNNITSLGLLIGVLMILYAISIRVFMSTTSKTKRD
```

YCR009C_homolog 882bp public: 1..882(SEQ ID NO 523)
```
ATGTGGAAAAAGAAAAAGAGGGAATTTTTTTTTGTCATTCATTTTTTTTTTCTTTTATCTCGCACAT
TTCTTTCTTCAACTAGACATGTCTTGGGGAGGATTTAAGAAAGCAATCAATCGAGCTGGCGCATCTGTT
ATTGTCAAGGATGTTGACAAGACTATGGATAAGGACTTTGATGTGGAGGAGAGAAGGTACAAGACCTTA
AAGACTGCAGGGACGAATTTACAGAAAGCTGCCAAGGGGTATTTGGACAACATCAGAGCAATCACGAAT
TCCCAAGTCACAATTGCCGAGATTATTTATAACTTGTACGAGGAGTCGAAGCAGGGACAATCGCTCTAC
TCGAATGTTGGGACTTATTACATGCAGAGTGTCAAGGAGTTTGATGAGGAGACTGTGAAACAGATTGAT
GGCCCGTATAGGGAGACTGTTTTGGATCCAATTGGAAAGTTTTCCAACTACTTTAGTGAGATTGACGAA
GCAATCAAAAGAGAGCACACAAGAAGATTGACTATGAGCAGTGCAAAGCCAAGTTAGACGGTAGTC
GATAAACCTGCCAAAGATGCGGCCAAGTTGCCACGCGCCGAGAAGGAATTGTCGATGGCCAAAGAGATT
TACGACGAGTTGAATGACCAGCTCAAGGCCGAGTTGCCGCAGTTGATTGCATTGAGGGTGCCTTTCTAC
GATCCGTCGTTTGAGGCGTTGGTCAAGATCCAGTTGAGGTTCTGTACTGAGGGGTACTCGAGATTGGCA
```

CAGATCCAACAGTACTTGGACCCAGCGTCCAGAGACGAGTATGCCAATGGGTTGTTGGACGGCAAGATT
GATGATATGTTGGCACAAATGCAAGGTTTGAGTATAACTTCTTTAGGAAAGTAG

YCR009C_homolog 293aa(SEQ ID NO 524)
MWKKKKREFFFCHSFFFFFYLAHFFLQLDMSWGGFKKAINRAGASVIVKDVDKTMDKDFDVEERRYKTL
KTAGTNLQKAAKGYLDNIRAITNSQVTIAEIIYNLYEESKQGQSLYSNVGTYYMQSVKEFDEETVKQID
GPYRETVLDPIGKFSNYFSEIDEAIKKRAHKKIDYEQCKAKVRRLVDKPAKDAAKLPRAEKELSMAKEI
YDELNDQLKAELPQLIALRVPFYDPSFEALVKIQLRFCTEGYSRLAQIQQYLDPASRDEYANGLLDGKI
DDMLAQMQGLSITSLGK YCR010C_homolog 858bp public: 1..858(SEQ ID NO 525)
ATGTCAGCTGATTTAGAAAATCAACAACCACAAGATCATCATCTTATTATTGAAAACAAGGGTGATAAC
AGTAGCAACCACCACCACCACCAACAACAATTCAACATCACCTTATGATCCTCATCATCCAATTACTAAA
ATTGAAACTGATGGAGATTATGTTACTTTTGGTAATGAAAGATATTTACGTTCTGATTTAGTTGAAGCA
TTTGGTGGTACTTTAAATCCAGGGTTAGCTCCACCACCTAAAAATGATTTTGCTAATCCTGCTCCATTG
GGATTATCGGCATTTGCTTTAACAACATTTGTTTTAAGTTTAATTAATTGTGAAGCTAGAGGGGTTACT
ATTCCTAATATTGTTGTTGGATTGGCATTTTTCTATGGTGGTGCTGCTCAATTAGTTGCTGGTATGTTT
GAATTGGCCCGTTGGTAATACTTTTGGTGGTGTTGCTTTGAGTTCATACGGAGGATTTTGGGGTGCTTGG
GCTGCTATTCAAGTTGATTCATTTGGTATTAAAGCTGCTTATGCTAATAATACTGAAGAATTACATTAT
GCTGTGGGGATATTTTTAATTGGTTGGTTTATTTTCACATTTTTCTTGATGCTTTTAACCGTTAAATCT
ACTGTGGCATTCTTTTTAATATTTTTCTTTTTAAGTATTACATTTTTATTATTGGCAATTTCTGATTTT
ACTGGTAAAGTGGCAATTAAAAAAGCCGGTGGAGTGTTTGGTTTAATTACTGCTTTTGTTGCTTGGTAT
AATGCTTATGCTGGTATTGCTAATCCTCAAAATAGTTATATTACTGTTAAAGCTATTCCATTACCAGAT
TTACAAGATCCAACAAGAAAAAATAAATAA YCR010C_homolog 285aa(SEQ ID NO 526)
MSADLENQQPQDHHLIIENKGDNSSNHHHHNNNSTSPYDPHHPITKIETDGDYVTFGNERYLRSDLVEA
FGGTLNPGLAPPPKNDFANPAPLGLSAFALTTFVLSLINCEARGVTIPNIVVGLAFFYGGAAQLVAGMF
ELAVGNTFGGVALSSYGGFWGAWAAIQVDSFGIKAAYANNTEELHYAVGIFLIGWFIFTFFLMLLTVKS
TVAFFLIFFFLSITFLLLAISDFTGKVAIKKAGGVFGLITAFVAWYNAYAGIANPQNSYITVKAIPLPD
LQDPTRKNK YCR021C_homolog 1029bp public: 1..1029(SEQ ID NO 527)
ATGTCCGCTGCTGTTTCAACTTTATCCGATATCATCAAACGTAATGATGCTGTTAACGTGAACCCACCA
AACCCAATTATTGATTTACATATCACTGAACATGGTAGTGATTGGCTTTGGGCTGTTTTTTCAGTTTTT
GCATTATTTGCAATTGTGCATGGATTCATTTACAGTTTTACTGACGTTAGAAAATCTGGTTTGAAGAGA
GCTTTATTGACTATCCCATTATTTAATAGTGCTGTTTTTGCCTTTGCTTACTATACTTATGCTTCTAAC
TTGGGCTATACTTGGATTTTGACAGAATTCAACCATGCTGGTACTGGTTTTAGACAAATCTTTTATGCA
AAATTTGTTGCTTGGTTCTTGGGTTGGCCATTAGTGTTGGCTATTTTCCAAATTATCACCAATACCAGC
TTTACTACTACTGAAGATGAGTCTGATTTGCTTAAGAAATTCATTTCTTTGTTTGAAGCTTTGTTTACT
AGAGTTTTGGCAATTGAAGTTTTCGTCTTGGGTTTATTGATTGGTGCTTTAATTGAATCTACTTACAAA
TGGGGTTATTTCACTTTTGCTGTTGTGTTCCAATTGTTTGCTATTTATTTAGTCATTAATGATGTGGTT
GTTTCATTTGGTTCATCTTCTCATTCAGTCTTTGGCAATGCTCTTATCCTTGCTTTTGTTATTGTTTGG
ATTTTGTACCCAGTTGCTTGGGGTTTGAGTGAAGGTGGTAATGTTATTCAACCAGATTCAGAAGCAGTG
TTCTATGGTATTTTGGATTTGATCACTTTTGGTGTTATTCCAATTATCTTGACTTGGATTGCCATTAAT
AACGTTGATGAAGAATTCTTCACCAAAATATGGCATTTCCATTTGAAACCAGAAATGAACATGCTCCA
ACTGCTACTGAAGATGTTGAAAAAGCAGTTGGTGAAACCCCAAGACATTCTGGTGATACTGCTGTTGCT
CCATCAGGTGTTCCAGACACTGGTGTTGCTCAAGCACAAGCCGAAGCTGAAGAACGTATTTAA YCR021C_homolog 342aa(SEQ ID NO 528)
MSAAVSTLSDIIKRNDAVNVNPPNPIIDLHITEHGSDWLWAVFSVFALFAIVHGFIYSFTDVRKSGLKR
ALLTIPLFNSAVFAFAYYTYASNLGYTWILTEFNHAGTGFRQIFYAKFVAWFLGWPLVLAIFQIITNTS
FTTTEDESDLLKKFISLFEALFTRVLAIEVFVLGLLIGALIESTYKWGYFTFAVVFQLFAIYLVINDVV
VSFGSSSHSVFGNALILAFVIVWILYPVAWGLSEGGNVIQPDSEAVFYGILDLITFGVIPIILTWIAIN
NVDEEFFTKIWHFHLKPENEHAPTATEDVEKAVGETPRHSGDTAVAPSGVPDTGVAQAQAEAEERI YDR178W_homolog 510bp public: 1..510(SEQ ID NO 529)
ATGATTTCAACTTATTCACGTATTGGTTTAACCACTTTAACTAAATCATCATCATCATCATTAACT
ACTACTGTTAGACCATTATTATTGGCCAATTTTACTAGAGGAATTAAAACTATTCCTCAACCACCAGGT
TATATTGTTGGTACAGTTAATGATGCTTATGTACCACCACCACCACATAAATTAGAAGGTTCATTACAT
TGGACTAGTGAAAGGATTGTTGCTATTGGTATGTTACCATTAGTTTTAGCACCATTTATTACTGGTGGT
GGTGCTTCGACTTTAATTGATTCCACCATGTCAGCATTATTATTTCATTGTCATACTGGTTTCCAA
AGTTGTATTATAGATGATATTCCTAAAAGAGTTTATGGATCTTATCATAATTATGCCATGTATTTATTG ACTTTTGGTACTGGTATTGCTGGTTATGGTATTTATCAAATTGAAACTAAAGAAGGTGGTGTTTCCAAT
ATTATTTCAAAACTTTGGAAAGCTTAA YDR178W_homolog 169aa(SEQ ID NO 530)
MISTYSRIGLTTLTKSSSSSSLTTTVRPLLLANFTRGIKTIPQPPGYIVGTVNDAYVPPPPHKLEGSLH
WTSERIVAIGMLPLVLAPFITGGGASTLIDSTMSALLLFHCHTGFQSCIIDDIPKRVYGSYHNYAMYLL
TFGTGIAGYGIYQIETKEGGVSNIISKLWKA YDR202C_homolog 387bp CDS: 1..>387 public: 1..387 (SEQ ID NO 531)
ATGACAGCAAATATCTTGAATAATAAAACATTCATAGATACTGTATTATCAATACAATCAACTCAAAAT
GATAAAGAATTACATTGGTATATTATAAATATAATTTTACCCGATTTACCTCAAATCATAGAGACTTTA
CAGATTTGTTCAAATTTGTTGATGTACAATTCACCACAAGAACCTGATTCCAAACAATGTATTGAAAAA
GGTCCATCTATCAAGCTACCTTTGTCTTTAACCAATCAACAAGATTCTGTCAATGGGATAATAACCCGA
GATGGACCATATATCACAGATCTTAATTTGACGGTTAAGAATCATTATTTCAACAAGCATTTCCATAAG
TTGCGCTTAATAAAGCCAATGGTTTTAGAACAACTTGTTAAT YDR202C_homolog 129aa(SEQ ID NO 532)
MTANILNNKTFIDTVLSIQSTQNDKELHWYIINIILPDLPQIIETLQICSNLLMYNSPQEPDSKQCIEK
GPSIKLPLSLTNQQDSVNGIITRDGPYITDLNLTVKNHYFNKHFHKLRLIKPMVLEQLVN YDR256C_homolog 1458bp public: 1..1458(SEQ ID NO 533)
ATGGCTCCAACATTTACGAATTCTAACGGTCAACCAATTCCAGAACCATTTGCCACTCAAAGAGTTGGT
CAACACGGTCCATTGTTGTTACAAGATTTCAACTTGATTGATTCATTGGCCCATTTCGATAGAGAAAGA
ATCCCAGAAAGAGTTGTCCACGCTAAAGGTTCCGGTGCTTATGGTGTTTTTGAAGTCACTGACGATATC
ACTGATATTTGTGCTGCCAAATTCTTGGACACTGTTGGTAAGAAAACTAGAATCTTCACCAGATTCTCT
ACTGTTGGTGGTGAATTAGGTTCTGCTGATACTGCTAGAGATCCAAGAGGTTTTGCTACCAAATTTTAC
ACTGAAGAAGGTAACTTGGATTTGGTTTACAACAACACTCCAGTGTTTTTCATTAGAGACCCATCTAAA
TTCCCACATTTCATCCACACCCAAAAGAGAAACCCAGAAACTCACTTGAAGGATGCTAACATGTTTTGG
GATTACTTGACTAGCAATGAAGAATCCATTCATCAAGTTATGGTTTTATTCTCCGACAGAGGTACTCCA
GCTTCTTACAGAGAAATGAATGGTTACTCTGGTCACACTTATAAATGGTCCAACAAAAAGGGTGAATGG
TTTTACGTTCAAGTTCATTTCATCAGTGACCAAGGTATTAAGACTTTGACCAACGAAGAAGCTGGTGCT
TTAGCTGGATCTAACCCAGATTACGCCCAAGAAGATTTGTTCAAGAACATTGCTGCTGGTAACTACCCA
TCATGGACTGCTTACATTCAAACCATGACTGAAGCCGAAGCTAAAGAAGCTGAATTTTCTGTGTTTGAT
TTGACCAAAGTTTGGCCACACAAGAAATACCCATTGAGAAGATTTGGTAAGTTCACTTTGAATGAAAAC
CCAAAGAACTACTTTGCTGAAGTTGAACAAGCTGCTTTCTCTCCAGCCCACACTGTTCCTTACATGGAA
CCATCTGCTGATCCAGTCTTGCAATCAAGATTGTTCTCCTATGCTGATACTCACAGACACAGATTGGGT
ACCAACTATACTCAAATCCCAGTGAACTGTCCTGTCACCGGTGCTGTTTTCAACCCACATATGAGAGAT
GGTGCTATGACTGTTAATGGTAACTTGGGTAGCCATCCAAACTACTTGGCCAGTGATAAGCCAGTTGAA
TTCAAACAATTTTCTCTCTTCAAGAAGACCAAGAAGTTTGGAATGGTGCTGCCACTCCATTCCACTGGAAA
GCCACCCCAGCTGATTTCAAACAAGCTCAAGAATTGTGGAAAGTGTTGAAGAGATATCCAAACCAACAA
GAACATTTGGCCCACAACATTGCTGTACATGCTGCTGGTGCTGATGCTGCTATCCAAGACAGAGTGTTT
GCATACTTTGGTAAAGTCTCTCAAGACTTGGCTGATGCTATCAAAAAGGAAGTTTTGGAATTATCTCCA
AGAAAATAA YDR256C_homolog 485aa(SEQ ID NO 534)
MAPTFTNSNGQPIPEPFATQRVGQHGPLLLQDFNLIDSLAHFDRERIPERVVHAKGSGAYGVFEVTDDI
TDICAAKFLDTVGKKTRIFTRFSTVGGELGSADTARDPRGFATKFYTEEGNLDLVYNNTPVFFIRDPSK
FPHFIHTQKRNPETHLKDANMFWDYLTSNEESIHQVMVLFSDRGTPASYREMNGYSGHTYKWSNKKGEW
FYVQVHFISDQGIKTLTNEEAGALAGSNPDYAQEDLFKNIAAGNYPSWTAYIQTMTEAEAKEAEFSVFD
LTKVWPHKKYPLRRFGKFTLNENPKNYFAEVEQAAFSPAHTVPYMEPSADPVLQSRLFSYADTHRHRLG
TNYTQIPVNCPVTGAVFNPHMRDGAMTVNGNLGSHPNYLASDKPVEFKQFSLQEDQEVWNGAATPFHWK
ATPADFKQAQELWKVLKRYPNQQEHLAHNIAVHAAGADAAIQDRVFAYFGKVSQDLADAIKKEVLELSP
RK YER103W_homolog 1971bp public: 1..1971(SEQ ID NO 535)
ATGTCTAAAGCTGTTGGTATTGATTTAGGTACAACCTATTCTTGTGTTGCTCATTTTGCCAATGATAGA
GTTGAAATTATTGCTAATGATCAAGGTAATAGAACTACCCCTTCATTTGTTGCCTTCACTGATACTGAA
AGATTGATTGGTGATGCTGCCAAGAATCAAGCTGCTATGAACCCAGCAAACACTGTTTTCGATGCTAAA
CGTTTAATTGGGAGAAAATTTGATGATCCAGAAGTTATAAATGATGCTAAACATTTCCCATTTAAAGTC
ATTGATAAAGCAGGTAAACCAGTGATTCAAGTTGAATATAAAGGTGAAACTAAAACATTTTCACCAGAA
GAAATTTCTTCAATGGTTTTAACAAAAATGAAAGAAATTGCTGAAGGTTATTTGGGTTCTACTGTTAAA
GATGCCGTTGTTACCGTTCCAGCTTATTTCAATGATTCTCAAAGACAAGCCACCAAAGATGCTGGTACT

```
ATTGCTGGTTTGAATGTTTTAAGAATTATTAATGAACCTACTGCTGCTGCCATTGCTTATGGTTTAGAT
AAAAAAGGTTCCAGAGGTGAACATAATGTTTTAATTTTCGATTTGGGTGGTGGTACTTTTGATGTTTCA
TTATTAGCCATTGATGAAGGTATTTTCGAAGTTAAAGCCACTGCTGGTGATACTCATTTGGGTGGTGAA
GATTTTGATAACAGATTAGTCAACTTCTTTATTCAAGAATTCAAGAGAAAGAACAAGAAAGATATTTCC
ACCAACCAAAGAGCTTTAAGAAGATTAAGAACTGCTTGTGAAAGAGCCAAGAGAACTTTGTCTTCTTCT
GCTCAAACCTCAATTGAAATTGATTCCTTATATGAAGGTATTGACTTCTACACTTCAATCACCAGAGCC
AGATTTGAAGAATTGTGTGCTGACTTGTTCAGATCCACTTTAGATCCAGTTGGTAAAGTTTTAGCTGAT
GCCAAGATTGATAAATCTCAAGTTGAAGAAATTGTCTTGGTTGGTGGGTCCACCAGAATTCCAAAGATT
CAAAAATTGGTTTCTGATTTCTTTAATGGTAAAGAATTGAATAAATCTATCAACCCTGATGAAGCTGTT
GCTTATGGTGCTGCTGTTCAAGCTGCCATTTTAACTGGTGATACTTCTTCCAAGACTCAAGATATTTTG
TTATTGGATGTTGCTCCATTGTCATTAGGTATTGAAACTGCTGGTGGTATCATGACCAAATTGATTCCA
AGAAATTCTACTATTCCAACTAAGAAATCAGAAACTTTCTCCACTTATGCCGATAACCAACCAGGTGTT
TTGATTCAAGTGTTTGAAGGTGAAAGAGCTAAAACTAAAGATAACAACTTGTTGGGTAAATTTGAATTA
TCTGGTATTCCACCAGCTCCAAGAGGCGTCCCTCAAATTGAAGTTACTTTCGATATTGATGCTAATGGT
ATCTTGAATGTTTCTGCTTTAGAAAAAGGTACTGGTAAAACTCAAAAGATTACTATCACCAACGATAAA
GGTAGATTATCCAAAGAAGAAATTGATAAAATGGTTAGTGAAGCTGAAAAATTCAAAGAAGAAGATGAA
AAGGAAGCTGCTAGAGTCCAAGCCAAGAATCAATTGGAATCTTATGCTTATTCATTGAAAAACACAATC
AATGATGGTGAAATGAAAGATAAGATTGGTGCAGATGATAAGAAAAATTAACTAAAGCCATTGATGAA
ACTATTTCTTGGTTAGATGCATCTCAAGCTGCTTCTACTGAAGAATACGAAGATAAACGTAAAGAATTA
GAATCAGTTGCTAATCCAATCATTAGTGGTGCTTATGGTGCTGCCGGTGGCGCTCCAGGTGGTGCAGGC
GGATTCCCAGGTGCTGGTGGCTTCCCAGGTGGTGCCCCAGGTGCCGGTGGTCCAGGTGGTGCTACTGGT
GGTGAATCAAGTGGACCAACTGTTGAAGAAGTTGATTAA

YER103W_homolog 656aa(SEQ ID NO 536)
MSKAVGIDLGTTYSCVAHFANDRVEIIANDQGNRTTPSFVAFTDTERLIGDAAKNQAAMNPANTVFDAK
RLIGRKFDDPEVINDAKHFPFKVIDKAGKPVIQVEYKGETKTFSPEEISSMVLTKMKEIAEGYLGSTVK
DAVVTVPAYFNDSQRQATKDAGTIAGLNVLRIINEPTAAAIAYGLDKKGSRGEHNVLIFDLGGGTFDVS
LLAIDEGIFEVKATAGDTHLGGEDFDNRLVNFFIQEFKRKNKKDISTNQRALRRLRTACERAKRTLSSS
AQTSIEIDSLYEGIDFYTSITRARFEELCADLFRSTLDPVGKVLADAKIDKSQVEEIVLVGGSTRIPKI
QKLVSDFFNGKELNKSINPDEAVAYGAAVQAAILTGDTSSKTQDILLLDVAPLSLGIETAGGIMTKLIP
RNSTIPTKKSETFSTYADNQPGVLIQVFEGERAKTKDNNLLGKFELSGIPPAPRGVPQIEVTFDIDANG
ILNVSALEKGTGKTQKITITNDKGRLSKEEIDKMVSEAEKFKEEDEKEAARVQAKNQLESYAYSLKNTI
NDGEMKDKIGADDKEKLTKAIDETISWLDASQAASTEEYEDKRKELESVANPIISGAYGAAGGAPGGAG
GFPGAGGFPGGAPGAGGPGGATGGESSGPTVEEVD YGR086C_homolog 954bp public: 1..954(SEQ ID NO 537)
ATGCATAGAACTTATTCTTTAAGATCCACTAGAGCTCCAACTGCATCTCAATTACAAGCTCCACCTCCA
CCACCATCATCTACCAAATCCAAATTTTTTGGTAAAGGTTCGATTAGTCATACTTTCCGTAAACAAGCT
GCTGGTGCTTTAGGTCCAGAATTGTCGAGAAAATTGGCCATTTTAATTAAAATGGAAAAAAATTTAATG
AGATCAATTGAAATCACTTCTCGTGAAAGAAAAGATGTTGCTAAACAATTATCTTTATGGGGTGAAGCT
AATGAAGATGATATTAGTGATATCACTGATAAATTGGGGGTTTTAATCTATGAAGTTGGTGAATTGGAA
GATCAATTTATTGATAGATATGATCAATATAGAATCACTTTGAAATCTATTAGAGATATTGAAGGTTCA
GTTCAACCAAGTAGAGAAAGAAAACAAAAAATTACTGATCAAATTGCTTATTTGAAATATAAAGATCCT
CAATCACCAAAAATTAATGTTTTAGAACAAGAATTGGTTAGAGCTGAAGCTGAATCTTTAGTTGCTGAA
GCTCAATTGAGTAATATTACTAGAGAAAAATTGAAAACTGCTTTTAATTATCAATTTGATTCTATTAGA
GAACACGCTGAAAAAATTGCTTTAATTGCTGGTTATGGTAAAGCTTTATTAGAATTATTAGATGAAAGT
CCAGTCACTCCAGGTGAAACTAGACCAGCTTATGACGGTTATGAAGCTTCTAAACAAATTATTATTGAT
GCTGAAAACGCTTTAGCTTCTTGGACTTTTGATTCTGCCGTTGTTCGTCCAACTTTATCATTAGCTGCT
CATGATGAAGAAGCAGAAGAAGATTTAGAAGGTGCTTATGAAGATGATGAATTGGCTAATGAAGCTGAA
AATTTAAGAATTGCTGAAAAAGATTTTGATGAAGTTGAAGCTAAAATTGCTGCTTAA YGR086C_homolog 317aa(SEQ ID NO 538)
MHRTYSLRSTRAPTASQLQAPPPPPSSTKSKFFGKGSISHTFRKQAAGALGPELSRKLAILIKMEKNLM
RSIEITSRERKDVAKQLSLWGEANEDDISDITDKLGVLIYEVGELEDQFIDRYDQYRITLKSIRDIEGS
VQPSRERKQKITDQIAYLKYKDPQSPKINVLEQELVRAEAESLVAEAQLSNITREKLKTAFNYQFDSIR
EHAEKIALIAGYGKALLELLDESPVTPGETRPAYDGYEASKQIIIDAENALASWTFDSAVVRPTLSLAA
HDEEAEEDLEGAYEDDELANEAENLRIAEKDFDEVEAKIAA YGR197C_homolog 1536bp public: 1..1536(SEQ ID NO 539)
ATGTCTCATGATGATTCAAATCTGAATTCAAACCCCAGCTCAAATCCAACCTCCAATCCTGTGTCAAAG
CCGTCTGATATGGGCAGATCAAGCAACGACAGTGGCTCCGAACCATCAATACAACATTTTACGTTAGCC
CCACTCGAACCACAAGGCGATCAAGAGGATATGGAAATGGGTGAGCCAATATCACGACAATCAACCTTT
CTTGAGAGAGTACAATCTCGATATTCATTTTTCCACGAGAATTTGCGAGCTCAAAGAAAGGAATTGTCC
```

ATGAAATATCTTAAAATTTATCTAGTCATGGCCATTGGTTGCTTAGGAGTGTTTTCTATATATTGGGGT
TCAATGTATCAAAGAGAAACCCGAATTAAAAACTTGAAAATGTTGGTAGTTTTAGAAGATGAAGAAATT
AATGGCATCCCTCCACTTTTTGGCAATCAGCTTCGTGATTTATTGGCCACCCCAACGGCTAGAACACTC
GGCGATTGGAAAATATATAACACTAGCGAATTTGAAACTATTGCATCAAAACACAACAACACAATAAAT
GAAGAGGTCATTCGTCAAATTCATCATCAAAATTATTGGGCCTCGATATATGTCAAGCAAAATTCATCT
TATAACATATACAATGCATTAGCCAATGGTAATCAGTACAATGTCAGTGACTCTGTGTATTGTTACTAT
GAAACAGGAAGACACCTAACTAGTGTTGGCCCATATGTGGTGGCATCTATAGATGCCATTCAAACTATG
TGGTTGGATCAAAACCTGGTGATGAGGGACATTGTGAGAATTGGTAATATAACTCTTGACAATGCAAAC
TCGGTTGCTGTCGCCACTACCGCCTTGGCATTCCAAATAATTGATATGAGACCATCTACTAGTGGAGTT
TTAGTTGCAGCTTTACAAATTGGTCTTCTTTATCTTGTCATTGTTAGTTTTTTCAGTTTCAATTTTTTT
GTCGATATACACCGATCAGTGGCATTAATGGTGAAGCAAAGAAACTTTTTACTTTATCGAGTTTTTGCA
TCAATCATATCGTATTTTGTTATCAGTTTAATGTTTGGTTTGGTTACTTTAGCGTTTCAAGTTGATTTT
GCTGTTACATTTGGTAAATCTGGCTTCTTAGTTTACTGGATGGTAACATTTTTAACAATGTGGAGTGTT
GGATTGGCTAACGAATTGGCCGCTATGCTCATACTTACTATCTATCCACCAATGGTTGGGTTTTGGTTG
ATCTTCTGGGTAATTATAAATATCACACCCACATTCACACCAATTGCTTTGTTACCTGAATTTTATCGG
TATGGTTACGCCATGCCATTGCATAATGCTTTTGAAATTTATTCTGTTATTTTTTTCAACACGTATAAG
GGATTAATAGGAAGAAGCATTGGAATCATAATTGCATGGGTGGTATTTTTAACATTAATGGCACCAATA
GTGGTGGTTTACTTTGGTAGCACTATGAGTAAAAAAGCTGCTGCTCCCGCTGCTGCTGCAAAAAAGGAA
AAGGAAAAGTCAAAGTAA

YGR197C_homolog 511aa (SEQ ID NO 540)
MSHDDSNSNSNPSSNPTSNPVSKPSDMGRSSNDSGSEPSIQHFTLAPLEPQGDEEDMEMGEPISRQSTF
LERVQSRYSFFHENLRAQRKELSMKYLKIYLVMAIGCLGVFSIYWGSMYQRETRIKNLKMLVVLEDEEI
NGIPPLFGNQLRDLLATPTARTLGDWKIYNTSEFETIASKHNNTINEEVIRQIHHQNYWASIYVKQNSS
YNIYNALANGNQYNVSDSVYCYYETGRHLTSVGPYVVASIDAIQTMWLDQNSVMRDIVRIGNITLDNAN
SVAVATTALAFQIIDMRPSTSGVLVAALQIGLLYLVIVSFFSFNFFVDIHRSVALMVKQRNFLLYRVFA
SIISYFVISLMFGLVTLAFQVDFAVTFGKSGFLVYWMVTFLTMWSVGLANELAAMLILTIYPPMVGFWL
IFWVIINITPTFTPIALLPEFYRYGYAMPLHNAFEIYSVIFFNTYKGLIGRSIGIIIAWVVFLTLMAPI
VVVYFGSTMSKKAAAPAAAAKKEKEKSK YGR250C_homolog 1890bp public: 1..1890 (SEQ ID NO 541)
ATGTCTGCTGCTGAAACTAATCAACTTCAAGAATCTATGGAAAAGTTGAACATTGGTTCAACTACTGAA
GAACAATCAGCTGCTGCTGCTACTACCACTGCTGATCAATCAGCTGAAGAACAAGGAGAATCATCTGGT
GTTGCCGAGAATTCTGCCTCCTTGTACGTTGGTGAATTGAACCCATCTGTTAATGAAGCTACCTTGTTC
GAAATCTTTTCTCCAATCGGTCAAGTTTCCTCTATCAGAGTTTGTCGTGATGCTGTCTCTAAAAAATCT
TTAGGTTATGCTTACGTCAACTACCACAAGTACGAAGATGGTGAAAAGGCTATTGAAGAATTGAACTAC
AACCCGATCGAAGGTCGTCCATGTCGTATCATGTGGTCTCAAAGAGACCCATCTGCTAGAAGATCTGGT
GATGGTAATATTTTCATCAAGAATTTGCATCCAGCCATCGATAACAAAGCTTTGCATGACACCTTTTCT
GCTTTTGGTAAAATTTTGTCTTGTAAGGTTGCCACCGATGAATTTGGTCAATCAAAGTGTTTTGGTTTT
GTCCACTATGAAACTGCTGAAGCTGCTGAAGCTGCCATTGAAAATGTCAATGGTATGTTATTGAACGAT
CGTGAAGTTTTCGTTGGTAAGCACATTTCTAAAAAAGACCGTGAATCTAAGTTTGAAGAAATGAAAGCC
AACTTCACTAACATTTATGTTAAAAACATTGACTTGAACTATTCAGAAGAAAGCTTTGAAAAATTGTTT
TCTCCATTCGGTAAGATTACTTCCATTTACTTGGAAAAAGACCAAGATGGGAAATCTAAAGGTTTTGGT
TTTGTTAATTTTGAAGATCATGAATCTGCTGTTAAGGCTGTTGAAGAATTGAACGATAAAGAAATCAAC
GGTCAAAAGATCTACGTTGGTAGAGCACAAAAGAAAAGAGAAAGATTGGAAGAATTGAAGAAACAATAC
GAAGCTGTTAGATTAGAAAAATTGGCCAAATACCAAGGTGTCAACTTGTTTGTTAAGAATTTGGATGAC
ACTATTGATTCTGAAAAATTAGAAGAAGAATTCAAACCATTTGGTACCATTACATCTGCCAAGGTTATG
GTTGATGAAGCTGGTAAATCAAAAGGTTTTGGTTTCGTTTGCTTCACAACCCCAGAAGAAGCCACCAAG
GCTATCACTGAAATGAACACCAGAATGATTAACGGCAAGCCATTGTATGTTGCTTTGGCTCAACGTAAG
GATGTTAGACGCTCTCAATTAGAACAACAAATTCAAGCCAGAAACCAAATGAGAATGCAAAATGCTGCT
GCTGGTGGTTTACCTGGTCAATTCATTCCACCAATGTTCTACGGTCAACAAGGCTTTTTCCCACCAAAT
GGCAGAGGTAACGCTCCATACCCAGGTCCTAATCCACAAATGATGATGAGAGGTAGAGGTCAACCATTC
CCAGAACAATGGCCAAGACCAGGTCCAAATGGCCAACCAGTTCCTGTCTACGGTATTCCACCTCAATTT
CAACAAGACTTTAACGGTCAAAACATGAGACCTCAGCAACAACAACAACAACAACCAAGAGGTGGATAC
TATCCAAACCGTAACCAAACCAGCAAGAGAGACTTGGCTGCTATCATTTCTAGTGTTCCACAAGATCAA
CAAAAGAGAATTTTGGGTGAAGAATTGTATCCAAAGATTGTTGCTACCGGTAAGGCTCAAGAACCAGAA
GCTGCTGGTAAAATCACTGGTATGATGTTAGGTTTAGAAAACCAAGAAATTTTGGATTTGTTAGATGAT
GATGAATTGTTCAATAACCATTTCGAAGATGCTTTGACTGCTTTTGAAGAGTACAAGAAGTCTGAAGCT
GCCGGTAATGCTGAAGAGCAAGCTTAA YGR250C_homolog 629aa(SEQ ID NO 542)
MSAAETNQLQESMEKLNIGSTTEEQSAAAATTTADQSAEEQGESSGVAENSASLYVGELNPSVNEATLF
EIFSPIGQVSSIRVCRDAVSKKSLGYAYVNYHKYEDGEKAIEELNYNPIEGRPCRIMWSQRDPSARRSG
DGNIFIKNLHPAIDNKALHDTFSAFGKILSCKVATDEFGQSKCFGFVHYETAEAAEAAIENVNGMLLND
REVFVGKHISKKDRESKFEEMKANFTNIYVKNIDLNYSEESFEKLFSPFGKITSIYLEKDQDGKSKGFG
FVNFEDHESAVKAVEELNDKEINGQKIYVGRAQKKRERLEELKKQYEAVRLEKLAKYQGVNLFVKNLDD
TIDSEKLEEEFKPFGTITSAKVMVDEAGKSKGFGFVCFTTPEEATKAITEMNTRMINGKPLYVALAQRK
DVRRSQLEQQIQARNQMRMQNAAAGGLPGQFIPPMFYGQQGFFPPNGRGNAPYPGPNPQMMMRGRGQPF
PEQWPRPGPNGQPVPVYGIPPQFQQDFNGQNMRPQQQQQQQPRGGYYPNRNQTSKRDLAAIISSVPQDQ
QKRILGEELYPKIVATGKAQEPEAAGKITGMMLGLENQEILDLLDDDELFNNHFEDALTAFEEYKKSEA
AGNAEEQA YKL117W_homolog 666bp public: 1..666(SEQ ID NO 543)
ATGTCCTCGACAACCACTCAAACTCCAACTGTATTATGGGCTCAACGTTCATCTGAAGATGACGCTGCC
AAAAATATCATTTATTTAACCATTCAAATATCTGATCCAATTGATTTAAAAATAGATTTAAAAAGTGAT
CATTTAATTATTGATTCTAAATCTAATGATTCAGTTTATTCATCAATTGATTATCATTTACAAATTGAT
TTTTTCAAAGAAATAGATCCTGATCAATCAAAAATTAATACTGAAAATGGTTCACATATTTTTATGATT
CTTCGTAAAAAAGATCAACAAGAAGAATATTGGCCACGTTTAACTAAAGAAAAATTGAAATATCATTAT
ATTAAAACTGATTTTGATAAATGGGTGGATGAGGATGAACAAGATGAAGTTAAAGATGATCCAAATGAT
TTTGGTGGACCTGGTGGACCTGGTGGAGCTATGGATTTCTCACAAATGTTGAGCGGCATGGGCGGTTTA
GGTGGCACTGGTGGAAGTGGCGGTCCTGGTGGCGTCGATCTTAGTGCATTGGCTTCTCAATTGGGTCAA
GCTGGTGGTGCTGGTGGTGCTGCAGGTCTTGATGGTGAAGAAGGCGAAGAAGGCGATGAAGAAGCTAAA
AAAGCGCAAGAAGAATCAAATGCCACTGCTACTGAAAAAGAATAA YKL117W_homolog 221aa(SEQ ID NO 544)
MSSTTTQTPTVLWAQRSSEDDAAKNIIYLTIQISDPIDLKIDLKSDHLIIDSKSNDSVYSSIDYHLQID
FFKEIDPDQSKINTENGSHIFMILRKKDQQEEYWPRLTKEKLKYHYIKTDFDKWVDEDEQDEVKDDPND
FGGPGGPGGAMDFSQMLSGMGGLGGTGGSGGPGGVDLSALASQLGQAGGAGGAAGLDGEEGEEGDEEAK
KAQEESNATATEKE YKR075C_homolog 3042bp public: 1..3042(SEQ ID NO 545)
ATGTCGTTATCAGGAGAAGTGTTTTCAGGAGGAGCAACCACTTCTCAACATATCGAGGCACAAGATGAT
GACCATTTTGAAAATACAACCTTTAAATTGAAAAGAACTAGATCCATGGGTTTATTAGATGAATTTATC
CCTGATAAACTAAAAGAACAAGATGGTAATAATTCAGAAGCAAATTCATCAACAACAGCTGCATCAACA
ACCAGCTCAAGAAACTTGGCAGCTATGGCAGCTATAGCATCACAAACAAATTCGTCATATGTTAACGAA
ACTCCAAGCAGTCAACATCATGAAACTATAGAATCCATATCTAATAACTCCGATGGCGATGTAACCCAT
TCATCAGATGTAGCGCCATCATCTACATCACCTGTCAATTCACCTTCACCAACTTCCTCACCAGCATTA
GATTTAAAATCTCCAGAATTGTTGCCTCATGATGATACAGATTTAGCTGTTGAACCTTCACGTCATGTT
GATTATTTATCCCACCAATGGGATGTTTCTGATATTTGGAAGTCTTGGCGATACGTTATTCCAAAAGA
AAAGATGTTGCTAATGCTGCAAGATTGGAAAATGCTTCATGGAGAACTTGGGCTCAAAGACGCTCTAAT
CTCAAGACTATAAGTCCAGAAGTGGTGAATTGGTCGAAAGATAGTGATGTTACTTGGCTTTATGGACCA
ATATTAAAAGATGATGACCATGTGAATAATGAAAATCACGACTCTGATGCTATTGAAACTACTGCTACT
AGTTCTGTTGCCGGGGATATATCTATTGCCAAAAAATGTTCCAGTAAGAATGGACCTAAACCAATATTG
AAAAAGAGAACAATGGAACAACTGATGATAAGTCATTCTAATTTATTAAAATTACAATTGGCAACACAA
ATACATCAAAAGAAAGAGAACAAAAATTGAAACAACAAGAAGAATTGAAAAGACAACATCAATTGAAT
CATCCCGATGAATATTTTGATCCCGAAGCCCTTCTGAACAAATTAAACAGTCAATATAAGAATACAGCT
CCTACTCATAACACTAGTGTGGCCAAATTACAAAGCTTGTTGAAAACTCCCAATTCTTCATCTTCTGCT
AGTTTGAAAGATTTGATGAAAGATGAAGCCGTTGTTGCCTTCTTCAGAACAAATCAGTCACGATCAA
AACCAAGAAGATGGTAATGTTTCTGGGGACGTTGAATCCAAAGGTGAAAGACACATACATTTTAATGAC
GAAGTGATGCAATGTATTGCCATTGATGTGTATTCAGATGTGAGCAACGATATAATTCTGATGAAGAA
GATTATGATTCTGATGATGACGATGATGATTATTATGATCAATATGAACCATCTAATGACAGTCTAGCT
CAAAGTCACCTATATGAAGGAGACGATGAATCCATTGAGGAAGCGGATGAAGAGGTAGAGGATGATGAA
GATGGATCTGAAGATGAAGAAGACGATGAAGGGGGATTCTTTTAAATGTGAAATCCAATTCCAATGCC
CCAATAATTTTGGGCCAGCATTCAAGTGCATCAACTTCTACTCCAGTGGCACCATCTTTAAGTCGTCAC
ACAGATATTACTGATGATACAGCATCAATATCTACCACCAACAGTAAATCTTATAAAACAATTCAATTA
TTACCTTCAACATCTATTAATTATGGTTCTGATGAATCTAGTGATGAGGCAAACCCTTATACGTCGAGT
CTTTCTCATAATGTCAATAATGATATTAGTAGAGGTTATGATTATTATTATGATTACAACACTGTATAC
ACATGTAATCCAAACAATTCAGTGTATCCACTTATCAAAGTCCAGATGTTGTTGATGTTCCAGAAAAT
CTTGATATGGGATCCAATTTTGATTATGAATTTATTGAAAATAACGATAGTATCCCTGTAGTAGATACA
ACATTTGAGAATAATAGTACCATTAATAATATGCCAATTCTGTATAGTCTGCCGTCATCACCTTTATCA
GTTGCTATTTCCGGTGGAGGTAAAAATTCTGGTGTCACTGTTAATTCCCCAAATTTCCCCATAGTTAAT
GTCAACTCTAACCCACAACAACAACAACAATCACAAGCAAAACCAAAGCCAAAGACAAAGGCATCTCCT

```
TTCCAATTGAGTGATTCAGAAGATGATTCAAATAGTGATTCGGATGATGATGGTATTTCAGGATTATCA
ATAGGTACAAGAAGATCTAGTCAAGCTTTAGCTGAACTGGTATTTCAATCATCATTGACAAGTTCTACA
CAAGAAACAGCACCACAACATTTCCCCGATGCTAAAGAGATTGAACCGGTTGCTGAACATGTTTCGAGT
ATTAACCCACGATATTCTTCGACTTCGATTTCTAAGCAACCTACAAGTTCAAGTTCACTTTCACAACTG
TTTTTCGGAGGTGCTGGTGGGTTAAGTAGTACTGATAAAGAGTTGTCGAAACTGTTTTTAGGAGGATCA
ACGTCAGCATCAACATCAACATCGCATGATGAGAAGACTACTACTATTGATTCTTCAAGTACTGGGTTT
TTCCAAGTACCAAATAGAGATTATACTCCTTCTCCAGATAATAATACTTTGACTCGTACATTATCTAAT
ACATCCAAGAAATCTTCACCATTACCACCACAAACAACTTCAGAGAATGCATTCAGAGGTGATGGACAA
CAATCACAATCACAATCACAATCACAGTTGCCACTGCAACAACAACTGCAACCACGACGGGGA
TTATTATTTGATGAAGAAGATTCTGAAGATTCTGAAGATGAAGGAATGGTTATTGGTGGTAAAAGAGAA
GAAAAGAAATTACATGGACAAGGATATAATGCATTAAGTCAAGTTGCAGGTAGAAATGGTATCCATAGT
CCAAGTCCACAATTTGGTAATGCTAGTGCACATCTTCAAGATCAAGATCAAGGTCATGAAAATGAACAT
GAACATGAACATGAAGAAAATCATAAGAATCTTGTTGGTCAAGCTAGAGGTTTAGCTAAACACTTCTTT
GGATAA
```

YKR075C_homolog 1013aa(SEQ ID NO 546)
MSLSGEVFSGGATTSQHIEAQDDDHFENTTFKLKRTRSMGLLDEFIPDKLKEQDGNNSEANSSTTAAST
TSSRNLAAMAAIASQTNSSYVNETPSSQHHETIESISNNSDGDVTHSSDVAPSSTSPVNSPSPTSSPAL
DLKSPELLPHDDTDLAVEPSRHVDYLSHQWDVSDIWKSWRYVISKRKDVANAARLENASWRTWAQRRSN
LKTISPEVVNWSKDSDVTWLYGPILKDDDHVNNENHDSDAIETTATSSVAGDISIAKKCSSKNGPKPIL
KKRTMEQSMISHSNLLKLQLATQIHQKKREQKLKQQEELKRQHQLNHPDEYFDPEALSNKLNSQYKNTA
PTHNTSVAKLQSLLKTPNSSSSASLKDLMKDEAVVVPSSEQISHDQNQEDGNVSGDVESKGERHIHFND
EVMQCIAIDVYSDDEQRYNSDEEDYDSDDDDDYYDQYEPSNDSLAQSHLYEGDDESIEEADEEVEDDE
DGSEDEEDDEGGFFLNVKSNSNAPIILGQHSSASTSTPVAPSLSRHTDITDDTASISTTNSKSYKTIQL
LPSTSINYGSDESSDEANPYTSSLSHNVNNDISRGYDYYYDYNTVYTCNPNNSVYASYQSPDVVDVPEN
LDMGSNFDYEFIENNDSIPVVDTTFENNSTINNMPISYSSPSSPLSVAISGGGKNSGVTVNSPNFPIVN
VNSNPQQQQQSQAKPKPKTKASPFQLSDSEDDSNSDSDDDGISGLSIGTRRSSQALAESVFQSSLTSST
QETAPQHFPDAKEIEPVAEHVSSINPRYSSTSISKQPTSSSSLSQSFFGGAGGLSSTDKELSKSFLGGS
TSASTSTSHDEKTTTIDSSSTGFFQVPNRDYTPSPDNNTLTRTLSNTSKKSSPLPPQTTSENAFRGDGQ
QSQSQSQSQSQLPSQQQSQPRRGLLFDEEDSEDSEDEGMVIGGKREEKKLHGQGYNALSQVAGRNGIHS
PSPQFGNASAHLQDQDQGHENEHEHEHEENHKNLVGQARGLAKHFFG YLR216C_homolog 1221bp public: 1..1221(SEQ ID NO 547)
```
ATGTGTAAAGTGGTGAGTGTGTTCGAGAACATTCCACCAGTATTTTTTCCAAATTTATATAAAAATGAG
ATAAAATTTTCGTTTCTGGTATTTTTCTTTTTCCACCAACTCATGACTGCCACACCTGTTTATTTTGAT
ATTTCATGCAACGGCAAACCCAAGGGCCGTGTTGTTTTCAAACTCTACGATGATGTTGTTCCTAAAACA
GCAGCTAATTTCCGTTCCTTATGTACTGGTGACAAAGGTATATCACCAAAATCTGGTAAACCACTTTCC
TATAAAGACTCAATTTTCCACAGAGTTGATCAAAGACTTTATGTGCCAAGGTGGTGACTTTACCGCTCCT
TCCGACCATTTGGGAACTGGTGGTGAGTCCATTTACGGAGAAAAGTTTGAAGATGAAAACTTTAAGTTG
AACCATAACAAACCATTTTTGTTGTCAATGGCTAACTCTGGACCAAACACCAATGGCTCTCAATTTTTT
ATCACAACAGTTCCAACACCACACTTGGACGGTAAACACGTTGTGTTTGGAGAAGTCATTGAAGGGAAA
TCAATTGTACGTCAATTAGAGAGAAGCGAAAAGGGTGCCAATGACAGACCAGTAGAAGATTGGAAAATT
GCTGATTGTGGTGAGCTTCCAGCCAACTATGAGCCGGTTGCACTGGGTGCCGATGATGGAACTGGTGAT
ACGTACGAAGAGATTTTAACCGACAACGACACTATCGACATCAACAACCCGCAATCTGTTTTCGCGGCT
GTCAGCAAAATCAAGGATATTGGTACCAAACTTTTGAAAGAAGGGAAATTAGAAAAATCATACGAAAAG
TATACCAAGGCCAATAGCTACTTGAATGATTACTTTCCCGAAGGTTTGTCTCCAGAAGACTTATCAACA
TTGCATGGCCTCAAATTATCGTGTTACTTGAACGCTGCGTTAGTGGCATTGAAATTGAAACACGGCAAA
GATGCAATTGCTGCTGCAAACAATGCATTAGAAGTAGAGCAAATCGACGACAAATCCAAAACCAAAGCA
TTATACAGAAAAGGTATGGGCTATATCCTAGTCAAAGACGAAGAACAGGCTCAAAAGATTCTTGAAGAA
GCTCTCGAATTAGAACCTAACGATGCTGCTATCCAAAAAGGATTACAAGAAGCTAAACACAACATCAAG
TTGCGTCGTGACAAACAAAAGAAGGCAATGGCCAAGTTCTTCTCATAA
```

YLR216C_homolog 406aa(SEQ ID NO 548)
MCKVVSVFENIPPVFFPNLYKNEIKFSFSVFFFFHQLMTATPVYFDISCNGKPKGRVVFKLYDDVVPKT
AANFRSLCTGDKGISPKSGKPLSYKDSIFHRVIKDFMCQGGDFTAPSDHLGTGGESIYGEKFEDENFKL
NHNKPFLLSMANSGPNTNGSQFFITTVPTPHLDGKHVVFGEVIEGKSIVRQLERSEKGANDRPVEDWKI
ADCGELPANYEPVASGADDGTGDTYEEILTDNDTIDINNPQSVFAAVSKIKDIGTKLLKEGKLEKSYEK
YTKANSYLNDYFPEGLSPEDLSTLHGLKLSCYLNAALVALKLKHGKDAIAAANNALEVEQIDDKSKTKA
LYRKGMGYILVKDEEQAQKILEEALELEPNDAAIQKGLQEAKHNIKLRRDKQKKAMAKFFS YMR009W_homolog 537bp public: 1..537(SEQ ID NO 549)
```
ATGGTCGAATTTTATTTTCATGATAACAAAGATACACTTGAAAATTTTACTGAAGATCACAATTCAGGA
GAACCAGTTAGTTTTGATCAACTAGCTGAAATTGGTGTTATTTACAAGTACATTACTACCCAGGAAGAA
```

```
TTAGACGCATTGGCTACTGAAAGAGAATACAAGAATAGAGATGTTGTTACTTTAAACTTACCAGCCTTC
AATAATGATATTGATGCTTATAATGCCAAAATGCAACAGTTTTACAAAGAACATTATCATGAAGATGAG
GAAATTAGATATATTGCTGAAGGTGAAGGTTATTTTGATGTTAGAGATAAACAAGATCGTTGGATTAGA
GCTAAATTATCACCTTACGATTTGTTGATTTTACCAGCAGGAATTTATCATCGTTTTACATTGACTAAT
GCTGCAAAACACGTCAAGGCAGTTAGATTATTTAAAGATGAACCTAAATGGGAAGCTATCAATAGAGAC
ACAGGAAAAAATACCGAAGCTCGTGAACTCTATGCTAAGACTATTGCAGTATAG

YMR009W_homolog 178aa(SEQ ID NO 550)
MVEFYFHDNKDTLENFTEDHNSGEPVSFDQLAEIGVIYKYITTQEELDALATEREYKNRDVVTLNLPAF
NNDIDAYNAKMQQFYKEHYHEDEEIRYIAEGEGYFDVRDKQDRWIRAKLSPYDLLILPAGIYHRFTLTN
AAKHVKAVRLFKDEPKWEAINRDTGKNTEARELYAKTIAV YMR011W_homolog 1641bp public: 1..1641(SEQ ID NO 551)
ATGTCTCAAGACAACGTCTCATCAACATCTACAGCTGAGGCTGTAAATAATGAAATCAAAGTCAAAGAT
GAATTTCGACAAGAAGAACAAGCTCATACTAGTTTAGAAGATAAACCTGTGAGTGCATACATTGGTATC
ATCATTATGTGTTTCCTTATTGCCTTTGGTGGTTTCGTTTTTGGTTTCGATACTGGTACTATTTCCGGT
TTCATTAATATGTCTGACTTTTTAGAAAGATTCGGTGGTACTAAAGCTGACGGTACTCTTTACTTTTCC
AATGTCAGAACTGGTTTAATGATTGGTTTGTTCAACGCTGGTTGTGCCATTGGTGCATTATTCTTGTCT
AAAGTCGGTGATATGTATGGTAGAAGGTTGGTATCATGACTGCTATGATTGTCTATATTGTTGGTATT
ATTGTTCAAATTGCTTCTCAACATGCTTGGTATCAAGTCATGATTGGTAGAATTATCACTGGTCTTGCC
GTTGGTATGTTATCAGTTTTATGTCCTTTGTTCATTTCCGAGGTTTCTCCAAAACATTTGAGAGGTACT
TTGGTGTGCTGTTTCCAATTGATGATTACCTTGGGTATCTTCTTGGGTTATTGTACTACCTATGGTACT
AAGAGTTACTCAGACTCTAGACAATGGAGAATTCCATTAGGTTTATGTTTTGCTTGGGCTTTATGTTTG
GTTGCTGGTATGGTTAGAATGCCAGAATCTCCACGTTACCTTGTCGGTAAAGACAGAATTGAAGATGCT
AAAATGTCACTTGCTAAAACTAACAAAGTTTCCCCAGAGGACCCAGCCTTATACCGTGAACTTCAATTA
ATTCAAGCTGGTGTTGAAAGAGAAAGATTAGCCGGTAAGGCATCTTGGGGTACTTTATTCAATGGTAAA
CCAAGAATCTTTGAAAGGGTTGTTGTTGGTGTCATGTTACAAGCCTTACAACAATTGACTGGTGATAAC
TATTTCTTCTACTACAGTACCACTATTTTCAAGTCCGTTGGTATGAATGATTCTTTCCAAACTTCTATC
ATTATTGGTGTTATTAACTTTGCGTCCACTTTTGTTGGTATTTATGCTATTGAAAGAATGGGTAGAAGA
CTCTGTTTGTTAACTGGTTCCGTTGCCATGTCTGTCTGTTTCTTAATCTATTCCTTGGTTGGTACTCAA
CATCTTTATATTGACAAACCAGGTGGTGCTAGTAGAAAACCAGATGGTGATGCCATGATCTTTATGACT
TCACTTTATGTGTTCTTCTTTGCTTCTACATGGGCTGGTGGTGTTTACTCCATTATTTCTGAACTTTAT
CCATTGAAAGTTAGAAGTAAGGCTATGGGTTTAGCTAATGCTTCCAATTGGACCTGGGGTTTCTTAATT
TCTTTCTTTACTTCATTTATTACTGATGCTATCCACTTCTACTACGGTTTCGTCTTTATGGGATGTTTA
GTTTTCTCCATTTTCTTTGTCTACTTTATGGTTTACGAAACTAAAGGTCTTACCTTGGAAGAAATTGAT
GAATTGTACTCCACCAAAGTCCTTCCATGGAAATCAGCTGGTTGGGTGCCACCTTCCGAAGAAGAAATG
GCAACCTCTACGGGATATGCTGGTGATGCCAAACCAGAAGAGGAACACGTTTAA YMR011W_homolog 546aa(SEQ ID NO 552)
MSQDNVSSTSTAEAVNNEIKVKDEFRQEEQAHTSLEDKPVSAYIGIIIMCFLIAFGGFVFGFDTGTISG
FINMSDFLERFGGTKADGTLYFSNVRTGLMIGLFNAGCAIGALFLSKVGDMYGRRVGIMTAMIVYIVGI
IVQIASQHAWYQVMIGRIITGLAVGMLSVLCPLFISEVSPKHLRGTLVCCFQLMITLGIFLGYCTTYGT
KSYSDSRQWRIPLGLCFAWALCLVAGMVRMPESPRYLVGKDRIEDAKMSLAKTNKVSPEDPALYRELQL
IQAGVERERLAGKASWGTLFNGKPRIFERVVVGVMLQALQQLTGDNYFFYYSTTIFKSVGMNDSFQTSI
IIGVINFASTFVGIYAIERMGRRLCLLTGSVAMSVCFLIYSLVGTQHLYIDKPGGASRKPDGDAMIFMT
SLYVFFFASTWAGGVYSIISELYPLKVRSKAMGLANASNWTWGFLISFFTSFITDAIHFYYGFVFMGCL
VFSIFFVYFMVYETKGLTLEEIDELYSTKVLPWKSAGWVPPSEEEMATSTGYAGDAKPEEEHV YMR110C_homolog 1986bp public: 1..1986(SEQ ID NO 553)
ATGAGTAAACCATCTTCCATCAAAAAGTCTAAGGCATCTGCTATTAAACCCTCGGCTAATTCAAAATCA
AAACCCCAAAAATTGAGACCCCAAAATTGCAACAAGTTGAAACACGATTAGAAGGCGAAGTTCCAACA
ACTAAAGTTTCAATTAAAAGAAACAGTATTACTACTGAATCTGTTAAGGCTTCAGAAGATAAGTCTACT
CCACAAAGCACTAACACCCCTGCTGCTGCTGTAGCAAAGTCTAATCCAAATACCAATGCAGAGCCAGCT
AAAATTCCAAACGAAAAACTGTTAAAAACAGAATCACCACTGAGTCAAAAACAAAACGGTGCAACAACA
ACAAAGGAAAAATCTGATGTTCTGTTGGAGACAAAATCGACGTCATCAACTACTGTCAGCAACAATAAC
TCGGTCTTACAATATACCGAGTTGTCGGAGATCCCTATTGGTGTTGAAAGAATTACTAAGGCCTTCCAT
AGTGGCAAAACACACTCTTTACAGTTTAGATTGAACAATTACGAAACTTGTACTTTACAATGAAAGAC
AACCAGGAAGCTTTGTGTGACGCTTTGCAAAAGGACTTTCACCGTCTTCCTTCCGAAACAAGAAACTAT
GAATTTGCCACTGGATTGAATGAGCTAGTGTTTATTATGTCACAGCTCCACAAATGGAGCAAACCACAA
CCTGTTGACGAGTTGCCATTGAATTTGTCTTTGAATCCAGTTTACATTGAGAGAATTCCTTTGGGAACA
ATTTTAGTCATTGCTGCTTTCAATTATCCGTTTTTTGTCTCGATCTCACCAATAGTTGGTGCAATAGCA
AGTGGCAACACAGTTGCACTCAAGCCTTCTGAGTTAACACCCCGTTTTTCCAAGCTTTTTACTGACTTG
TTGTCAAAAGCATTGGACCCAGAGATATTTTTTGTTGTCAATGGGGCCATTCCTGAAACAACATGCTTG
```

```
TTGGAACAAAAATTTGACAAAATTGTTTATACTGGTAGCGGTTTGGTAGGTACAATAATTGCGAAAAAG
GCTGCGGAAACCTTGACACCAGTTATTTTGGAGTTGGGAGGAAAGTCACCTGCTTTTGTTTTGGATGAC
ATTTCTGACAAGGACTTGGCAACTGTTGCTCGAAGAATTGCTTGGGGTAGATTTGTAAATGCTGGTCAA
ACATGTATCGGTGTTGACTATGTATTGGTGGCAAAGTCCAAGCACGACAAATTTATCCTGGCCTTGCAA
GAGGTAATTGAAAAGAGTTTTTTCAAGACGTTGACAAGACGAGAAACTTTACCCATATGATCCATGAC
CGGGCATTTGAGAAATGGAGAGTATACTCAACACTACTTCTGGTAATGTGATAATTGGAGGCAAGCTT
GATCATGGCACAAGATATGTGGGACCTACCGTGATTGATAACGTAACCTGGACAGATTCCTCTATGAAA
GACGAGATTTTCGGTCCAATTTTACCAATTTTAACCTACACTGATCTTGAAAAATCCTGTCGTGAAATT
ATTGCTAACCACGATACTCCCTTGGCACAATATATCTTTACAAGTGGACCTACATCTAGACAGTATAAT
TCCCAAATTAACACTATTACCACTTTGGTTAGATCTGGGGGATTGGTTATCAATGACGTTTTGATGCAT
ATTGCTTTGCACAATGCTCCGTTTGGTGGTGTTGGAACTTCGGGAAACGGTGCCTATCATGGAGAGTTC
TCATACAGAGCTTTCACACATGAGAGGACCGTTCTCGAACAACATTTGTGGAATGATTGGGTACTCAAA
TCAAGATATCCCCCATATGCCAATAAAAAAGACAAATTGATCGCCAGCTCCCAACAAAAGTACGGTGGT
AGAGTTTGGTTCAATAGAGAAGGGAATGTGAGAATTGGAGGTCCACCCCTCTTGTTTTCTGCTTGGAAC
AATGCTCTTGGGGTAGCTGAATTAGTACGTGATTTTATTGGAGCTGGTTTGTGA
```

YMR110C_homolog 661aa(SEQ ID NO 554)
MSKPSSIKKSKASAIKPSANSKSKTPKIETPKLQQVETRLEGEVPTTKVSIKRNSITTESVKASEDKST
PQSTNTPAAAVAKSNPNTNAEPAKIPNEKSLKTESPSSQKQNGATTTKEKSDVSLETKSTSSTTVSNNN
SVLQYTELSEIPIGVERITKAFHSGKTHSLQFRLKQLRNLYFTMKDNQEALCDALQKDFHRLPSETRNY
EFATGLNELVFIMSQLHKWSKPQPVDELPLNLSLNPVYIERIPLGTILVIAAFNYPFFVSISPIVGAIA
SGNTVALKPSELTPRFSKLFTDLLSKALDPEIFFVVNGAIPETTCLLEQKFDKIVYTGSGLVGTIIAKK
AAETLTPVILELGGKSPAFVLDDISDKDLATVARRIAWGRFVNAGQTCIGVDYVLVAKSKHDKFISALQ
EVIEKEFFQDVDKTRNFTHMIHDRAFEKMESILNTTSGNVIIGGKLDHGTRYVGPTVIDNVTWTDSSMK
DEIFGPILPILTYTDLEKSCREIIANHDTPLAQYIFTSGPTSRQYNSQINTITTLVRSGGLVINDVLMH
IALHNAPFGGVGTSGNGAYHGEFSYRAFTHERTVLEQHLWNDWVLKSRYPPYANKKDKLIASSQQKYGG
RVWFNREGNVRIGGPPLLFSAWNNALGVAELVRDFIGAGL YNL031C_homolog 411bp public: 1..411(SEQ ID NO 555)
```
ATGGCTAGAACAAAACAAACAGCAAGAAAATCTACTGGTGGTAAAGCCCCAAGAAAACAATTAGCTTCC
AAAGCTGCTAGAAAATCTGCTCCATCTACTGGTGGTGTCAAGAAACCACACAGATATAAGCCAGGTACT
GTTGCCTTGAGAGAAATTAGAAGATTCCAAAAATCTACTGAATTATTGATTAGAAAATTACCATTCCAA
AGATTAGTCAGAGAAATTGCTCAAGATTTCAAAACTGATTTAAGATTCCAATCTTCTGCTATTGGTGCT
TTACAAGAAGCCGTTGAAGCTTACTTGGTTGGTTTATTCGAAGATACTAACTTGTGTGCTATCCATGCT
AAGAGAGTTACCATTCAAAAGAAAGATATGCAATTAGCTAGAAGATTGAGAGGTGAAAGATCTTAG
```

YNL031C_homolog 136aa(SEQ ID NO 556)
MARTKQTARKSTGGKAPRKQLASKAARKSAPSTGGVKKPHRYKPGTVALREIRRFQKSTELLIRKLPFQ
RLVREIAQDFKTDLRFQSSAIGALQEAVEAYLVGLFEDTNLCAIHAKRVTIQKKDMQLARRLRGERS YNL134C_homolog 1086bp public: 1..1086(SEQ ID NO 557)
```
ATGAAAGCAGCTATCATTTCTGGATCTTTCGAACCTTATCAATTAGCGGAAATTAAAGATATTCCTCAA
CAAAAAATAAAAGAAAATGAAATATTAATCAAAGCAGTAGCTTTTGCAATAAACCCAACTGATTGGAAG
CACATTGTTTATCAATTGGGCAGCCCAGGTGATGTTGTTGGTTGCGATGTTAGTGGGATCATTGAAGAA
GTGGGTTCTCAAGTAACTGGGTTTGCAAAAGGTGACACTGTAAGTGCTTTTATAACTGGTAATAGATCA
CCTCGCACTGGAGCTTTTGCAGAATATGTAGCTGTTGATCCTGCTACTTCGATAAAGTACAATAAGAAT
TTTGAACATTTGACTAATTTACAAGTATCTGAAATCCACTCATTTGAAGGGGCAGCAAGTATTAATTTA
GGTTTGGTTACCGTTGGGCTTTCATTTTCTCATTACTTACGAATTGACAACAAAAAGCAACCTGGGGAT
AGTATTTTGATTTGGGGAGGAGCAACTGCAACTGGAGTTCTAGCCATTCAGGTTGCCAAACTAGTGTAT
AATCTCAAAGTAATCACCACAGCATCACCCAAAAACCACACCCTCTTGAAACAATTAGGGGCAGATTAT
GTTTTCGATTATGGAGACGCTGATGTTGTCAATAAAATTAAGAATATTGGCCAAATTAAATTTGCTCTT
GATACGATTGCAACACCAGAAACGTTTCAAAAAGTTTACGACTCAACAGAGGGGTCTCAAGAAGTATTT
ATTGATTCCTTAGCAGGTTTAGACTATCGATCAATTGCTGCCAATGATGCCAGAGGAGATCAAGTACAT
TGGGGGCACACCATTGCTTGTTTGGCATCTTTAAAAGAGAAACTGTGTTTAATGAAAATTATGTTCAA
ACACCTGAATTGTTAGATGATTTTACTCAGTGGTGGCAAAAGGTGGTCCCTCAAATAATTGATCGTATT
AAACATACAAATTTAAAGTTATTAAATGAAGGATTAGACTCCGTAAGTGAAGGGTTAGAATTGTCTAGA
AATAATAAACTCTCTGCTGAAAAGGTTGTATTTAGAGTTCTGGATCTGTGA
```

YNL134C_homolog 361aa(SEQ ID NO 558)
MKAAIISGSFEPYQLAEIKDIPQQKIKENEILIKAVAFAINPTDWKHIVYQLGSPGDVVGCDVSGIIEE
VGSQVTGFAKGDTVSAFITGNRSPRTGAFAEYVAVDPATSIKYNKNFEHLTNLQVSEIHSFEGAASINL
GLVTVGLSFSHYLRIDNKKQPGDSILIWGGATATGVLAIQVAKLVYNLKVITTASPKNHTLLKQLGADY
VFDYGDADVVNKIKNIGQIKFALDTIATPETFQKVYDSTEGSQEVFIDSLAGLDYRSIAANDARGDQVH
WGHTIACLASLKEKTVFNENYVQTPELLDDFTQWWQKVVPQIIDRIKHTNLKLLNEGLDSVSEGLELSR
NNKLSAEKVVFRVSDS YNR002C_homolog 798bp public: 1..798(SEQ ID NO 559)
ATGACGTCTTCATCTTCTCAAAAATCTGTTGGATCTTCAATCATAGATGCAAACCAAGGACCAATAAAA
AAAGTTGAAATTGCTGGAGAGGGTGGTGAATTGTTATTATCAATCGTCACAAGTACTACAGACATGAC
TTGATGGCTGCCTTCGGGGGTACTTTTAAACCCAGGTGCTTCTCCTTGGCCAAAGATCAATATCAACCCT
GCTCCCCTCGGGTTATGTGGGTTTGCCATGACCACTTTTGTCTTATCCCTTTTACAATGCCCAAGCTATG
GGTATCAAAGTTCCAAATGTGGTAGTTTCACTTGCATGTTTCTACGGTGGTGCAGCTCAATTTTTTGCT
GGATGTTTTGAGTTTGTGACTGGAAATACATTTGGTATGACTGCATTGACATCTTACGGTGCCTTCTGG
TTGAGTTATTCAGCAATCTTGGTTGATAGTTTTGGTATCGCTGCAGCCTACGAAGCTTCTGAAGAAACA
GCTTCACAGTTACCAAATGCCATTGGATTTTTCTTACTTGCTTGGGGTATCTTTACATTTATGTTGTGG
TTGAACACTTTAAAATCTACAGTTACTTTCAGTTCCTTGTTTTTCTTATTGTTTGTAACATTCCTTTTG
TTAGCTGGTGGTGAATTTAGTGGAAGAGTCGGTGTTACTAGAGCTGGTGGTGTTTTTGGTGTTATCACA
GCCATTGTTGCTTGGTGGAATGCCTTAGCCGGTACTGCTACTCCAACCAACTCTTACTTCCAACCTGTT
TCTATTCCATTGCCAGGTAACGTTGTTTTCAAGAAATAG YNR002C_homolog 265aa(SEQ ID NO 560)
MTSSSSQKSVGSSIIDANQGPIKKVEIAGEGGEFVIINRHKYYRHDLMAAFGGTLNPGASPWPKININP
APLGLCGFAMTTFVLSLYNAQAMGIKVPNVVVSLACFYGGAAQFFAGCFEFVTGNTFGMTALTSYGAFW
LSYSAILVDSFGIAAAYEASEETASQLPNAIGFFLLAWGIFTFMLWLNTLKSTVTFSSLFFLLFVTFLL
LAGGEFSGRVGVTRAGGVFGVITAIVAWWNALAGTATPTNSYFQPVSIPLPGNVVFKK YOL139C_homolog 630bp public: 1..630(SEQ ID NO 561)
ATGTCTGAAGAATTAGCTCAAAAAACTGAAGAATTGTCATTAGATTCCAAGACTGTTTTTGATTCCAAA
GAAGAATTTAATGCAAAGCATCCATTGAACAGTAGATGGACATTATGGTACACTAAACCACAAACCAAC
AAGAGTGAAAACTGGCATGATTTATTAAAGCCAGTTATAACTTTCTCATCTGTTGAAGAATTTTGGGGA
ATTTACAACTCGATTCCACCAGCAAATCAATTACCTTTGAAATCAGATTATCATTTGTTCAAAGAAGGA
ATTAGACCGGAATGGGAAGATGAGGCTAACTCAAAAGGTGGTAAATGGCAATTCTCCTTCAACAAAAAA
CTGGAAGTCAATCCAATCATAAATGATTTGTGGTTAAGAGGTTTGTTGGCAGTTATTGGTGAAACCATT
GAGGATGAAGAAAACGAAGTCAATGGGATTGTGTTGAATATCAGAAAGCAAGCTTACAGAGTCGGTATT
TGGACCAAAGATTGTGATGAATCCAAATTAAAGACTGTCGGTGAGAGATTGAAGAAAGTCTTGCAATTA
AACGATGAACAAAAAGTTGAATTCATGTCGCATGATGCTTCCAATACTAGAGGCGCTGAACCTCAAATT
GTTTTGTAA YOL139C_homolog 209aa(SEQ ID NO 562)
MSEELAQKTEELSLDSKTVFDSKEEFNAKHPLNSRWTLWYTKPQTNKSENWHDLLKPVITFSSVEEFWG
IYNSIPPANQLPLKSDYHLFKEGIRPEWEDEANSKGGKWQFSFNKKSEVNPIINDLWLRGLLAVIGETI
EDEENEVNGIVLNIRKQAYRVGIWTKDCDESKLKTVGERLKKVLQLNDEQKVEFMSHDASNTRGAEPQI
VL YOR120W_homolog 888bp public: 1..888(SEQ ID NO 563)
ATGCCAGCTCAATTGCAAGTTAACACTGATTATTTCACTTTAAACAATGGAAACAAAATCCCAGCTGTT
GGATTAGGTACTTGGCAAGCAACCAATGAAGACGAAGCTTACAGAGCCGTCTTAGCAGCTCTTAAGAAC
GGATACAAGCACATTGATACCGCTGCAATTTATGGAAATGAAGAACAAGTCGGTAAAGCCATCAAGGAC
TCTGGAGTTCCAAGAGAAGAATTGTTTGTTACTACTAAATTGTGGAATGCTGACCATAAAAATATTGAA
GAAGCCTTAGAGACTTCATTGAAAAAATTGGGTCTTAACTATGTTGACTTGTACTTGATCCATTGGCCA
GCTTCAATTGACAAGTCAACTAATAAACCATATACTGATTTTGATTATGTTGATACTTATAGAGGTTTA
CAAAAAGTTTATAAGAACAGCAAGAAAATCAGAGCAATTGGTGTTTCTAATTTCACCAAAAAGAAATTG
GAAAGGTTATTGTCTTCGGAAGGTGTCGATGTTGTTCCTGCTGTCAACCAAATTGAAGCTCACCCATTG
TTGACTCAGCCTGAATTGTATGATTATTTGAAAGAAAAAGGTATCGTTTTGGAAGCTTATTCACCATTG
GGTTCTACAAACTCTCCATTATTCAAGAACGAAACCATCGTTAAAATCGCTGAAAAGAATGGTGTTGAA
CCAGCTCAAGTTTTGGTATCTTGGGCAATTCAAAGAAAGACTGTGGTTTTGCCTAAATCCGTCACCGAA
TCAAGAGTTATTTCTAACTTGAAAACATTCACTTTACCTTCAGAAGATTTCGAAACATTGAACAAATTG
TCTGAAAAAGATGGTGTTGTCAGAACTTGTAACCCAGCTTTCAACAACTTTGATGATTAA YOR120W_homolog 295aa(SEQ ID NO 564)
MPAQLQVNTDYFTLNNGNKIPAVGLGTWQATNEDEAYRAVLAALKNGYKHIDTAAIYGNEEQVGKAIKD
SGVPREELFVTTKLWNADHKNIEEALETSLKKLGLNYVDLYLIHWPASIDKSTNKPYTDFDYVDTYRGL
QKVYKNSKKIRAIGVSNFTKKKLERLLSSEGVDVVPAVNQIEAHPLLTQPELYDYLKEKGIVLEAYSPL
GSTNSPLFKNETIVKIAEKNGVEPAQVLVSWAIQRKTVVLPKSVTESRVISNLKTFTLPSEDFETLNKL
SEKDGVVRTCNPAFNNFDD YOR122C_homolog 381bp public: 1..381(SEQ ID NO 565)
ATGTCTTGGCAAGCCTACACTGATAACTTAATTGCTAACGGTAAAGTCGATAAAGCAGCCTTATATTCA
AGAGCCGGTGACGCATTATGGGCCCAATCGGGATCATTCGAATTACAACAACCAGAAATCACTGAAATT
GCCAAAGGTTTCGATAGTGCTGAAGGTTTGCAAACCAGCGGTTTACACGTTCAAGGCCAAAAGTACTTT
TTGTTAAGAGCTGACGACAGATCAATTTATGGTAAACACGAAGCCGAGGGTGTTATTTGTGTTAGAACT
AAACAAACTATTTTGATCGCCCATTATCCAAGTGGTGTTCAACCAGGTGAAGCTACCACTCTTGTTGAA
AAATTAGCCGATTACTTGATCAATGTCGGTTATTAG YOR122C_homolog 126aa(SEQ ID NO 566)
MSWQAYTDNLIANGKVDKAALYSRAGDALWAQSGSFELQQPEITEIAKGFDSAEGLQTSGLHVQGQKYF
LLRADDRSIYGKHEAEGVICVRTKQTILIAHYPSGVQPGEATTLVEKLADYLINVGY YOR261C_homolog 993bp public: 1..993(SEQ ID NO 567)
ATGTCAACAACTGCAACTAGCACAAATGAATTGGCCCTTTTGGATAAGTCAGTAGTAGTTTCTCCGTTG
GTTTTACTATCTGTGGTGGACCATTATAATAGAGTTGCCAAAGATTCTAAGAAGAGAGTTGTTGGGGTA
ATATTAGGAGATAACTCTACTGACACAATCAAAGTTACAAACTCGTACGCAATTCCTTTTGAAGAAGAC
GAGAAGAACCCTGGAGTATGGTTTTTGGACCACAATTTTATAGATTCAATGGGAGAAATGTTTAAAAAA
ATTAATGCCAAAGAGAAATTGATTGGCTGGTACCATTCAGGACCTAAATTGAAACCATCAGATTTGAAA
ATTAATGAGGTTTTCAGAAGATACACCGACAACCCATTGTTGTTAATTGTTGACGTTCAACCAAGAGAA
GTTGGTATTCCAACAGATGCATATTTTGCCGTTGATGATATTAAAAACGATGGCTCTGCTGCTGAAAAG
ACATTTATTCATGTCCCTTCCTTGATTGAAGCAGAAGAAGCTGAAGAAATTGGAGTTGAACATTTGTTA
AGAGACATCAGAGACCAAGCTGCTGGTAACTTGTCCTTAAGAGTTTCTGAAACACATCAATCATTATTG
GGTTTACATCAGAAGCTTGGAGAAATTGCAAATTATTTGGATAAGGTTTACCAAAAGAAATTACCTATG
AATCATACTATTTTGGGGAAATTACAGAATGTTTTTAATTTGTTGCCAAACTTGATGCAACAACTGGGG
AGTGATCTCGATGGTGGTTCAGACTCGTCTCATGCATTAGCCACTGCATTTACTGTCAAGACAAATGAC
GAATTGATGATCATATACATTAGTACATTAGTTCGAGCTATTATTGCATTCCATGATTTGATCGAAAAC
AAGTTAGAAAATAAAAAGTTGAACGAAAATAAAGCACAAGCTTCCGTGGCTGAACTGTCATTAAATAGC
GAAAAGAAAGATTCTATAGAAGATTAA YOR261C_homolog 330aa(SEQ ID NO 568)
MSTTATSTNELALLDKSVVVSPLVLLSVVDHYNRVAKDSKKRVVGVILGDNSTDTIKVTNSYAIPFEED
EKNPGVWFLDHNFIDSMGEMFKKINAKEKLIGWYHSGPKLKPSDLKINEVFRRYTDNPLLLIVDVQPRE
VGIPTDAYFAVDDIKNDGSAAEKTFIHVPSLIEAEEAEEIGVEHLLRDIRDQAAGNLSLRVSETHQSLL
GLHQKLGEIANYLDKVYQKKLPMNHTILGKLQNVFNLLPNLMQQSGSDLDGGSDSSHALATAFTVKTND
ELMIIYISTLVRAIIAFHDLIENKLENKKLNENKAQASVAESSLNSEKKDSIED YPR035W_homolog 1122bp public: 1..1122(SEQ ID NO 569)
ATGACTACTTCCCTTACAGAACAAACTGCTATTTTGGCCAAATATTTGGAATTGTCTCAAAATGGTAAA
ATCTTAGCTGAATACGTCTGGATTGATGCTGAAGGTAACACTAGATCCAAATGTAGAACTTTATCCAAA
AAACCAACTAGTGTTGATGATTTACCTGAATGGAATTATGATGGTTCATCTACTGGTCAAGCTCCAGGC
CATGATTCTGATGTGTATTTAAGACCAGTTGCTTTTTATCCTGATCCATTTAGAAAAGGTGACAATATC
ATTGTTTTAAATGAATGTTGGACAATGATGGTACTCCAAACAAATTTAATCATCGTCATGAATGTGCT
AAATTGATGAAGGCTCATGCTAGTGAAGAAGTTTGGTTTGGTTTAGAACAAGAATATACTTTATTTGAT
CAATATGATTATCCTTATGGTTGGCCAAAAGGTGGATTCCCAGCTCCTCAAGGTCCATTCTACTGTGGG
GTTGGTACTGGTAAAGTTGTTGCTAGAGATGTCATTGAAGCTCATTATCGTGCTTGTCTTTATGCTGGT
ATCAACATTTCTGGTATTAATGCCGAAGTTATGCCATCTCAATGGGAATTCCAAGTTGGTCCATGTGAA
GGTATTGAAATGGGTGATCAATTATGGATTGCTCGTTATTTATTACAAAGAGTTGCTGAAGAATTTGCC
GTCAAGATTTCCTTCCATCCAAAACCTTTGAAAGGTGATTGGAATGGTGCTGGTTGTCATACTAATGTT
TCTACCAAATCTATGAGAGTGCCTGGTGGTATGAAAGTTATTGAATCTGCTTTGAGTAAATTGGCCAAA
AGACACAAGGAACATATGTTATTGTATGGTGCCGATAATGATCAAAGATTAACTGGTCGTCATGAAACT
GGTCATATGGATACTTTTTCATCAGGTGTTGCTAACAGAGGTGCATCTATCAGAATTCCAAGACAAGTT
GCTAAAGAAGGATATGGTTATTTCGAAGATAGAAGACCAGCTTCTAACATTGATCCATACTTGGTCACT
GGTATCATGGTGGAGACAATCTGTGGTTCTATTCCAGATGCTGATATGGCTAAAGAATTCCTTAGAGAA
AGCAGTGATGATAACTAA YPR035W_homolog 373aa(SEQ ID NO 570)
MTTSLTEQTAILAKYLELSQNGKILAEYVWIDAEGNTRSKCRTLSKKPTSVDDLPEWNYDGSSTGQAPG
HDSDVYLRPVAFYPDPFRKGDNIIVLNECWNNDGTPNKFNHRHECAKLMKAHASEEVWFGLEQEYTLFD
QYDYPYGWPKGGFPAPQGPFYCGVGTGKVVARDVIEAHYRACLYAGINISGINAEVMPSQWEFQVGPCE
GIEMGDQLWIARYLLQRVAEEFAVKISFHPKPLKGDWNGAGCHTNVSTKSMRVPGGMKVIESALSKLAK
RHKEHMLLYGADNDQRLTGRHETGHMDTFSSGVANRGASIRIPRQVAKEGYGYFEDRRPASNIDPYLVT
GIMVETICGSIPDADMAKEFLRESSDDN YMR099C_homolog 900bp public: 1..900(SEQ ID NO 571)
ATGCCAGTTGAAGAGCTTGAAGACCGTGTTATCATTACTGATCCAAATGACTCAACTAACAGAGCCACC
ATTTTGAAATTTGGTGCTACTGTAGTTTCTTGGAAAAACAATAATCAAGAAAAATTGTGGTTATCAGAA
GGTGCTCATTTAGATGGAAGTAAAGCCGTTAGAGGTGGTATCCCATTAGTTTTCCCAGTTTTCGGTAAA
CAAAAAGATTCAAATCATCCAACTTTCAAATTACCTCAACATGGATTTGCTCGTAATTCAACTTGGGAA
TTCTTGGGACAAACTCAAGAAAGTCCTATTACGGTTCAATTTGGATTAGGTCCAGAAAATGTTGATCCA
GAAACTTTGAAATTATGGAATTATGATTTCACTTTGATTTTAACTGTTAGTTTGACTAAAGATAAATTG
GTTACTTCAATTGACGTGGAAAACACTGGTAAAGAAGCATTTGAATTTAATTGGTTGTTCCATACATAT
TATAGAATCCATGACATCACCGATACATTAGTTACCAATTTAATTGACCAACAATGTTACGATCAATTG
ATTGGTGAATCATATATCGAAAAGGCACCAGTTATCAGTTTCCATGAAGAATTTGATAGAATTTATTCA
AAAGTCAGTTTGGAAAAATCCATTCAAGTCGTTGATAAAGGTCAAGTTCTTTTCAATCTTCATAGAAAA
AACTTGCCTGATTCCGTTGTATGGAATCCATGGACTAAGAAAGCTGAAGGTATGGCTGATTTCCAACCA
AAATCAGGGTTTCATCAAATGGTCTGTGTTGAGCCAGGTCATGTTAACTCAATGGTCTCTTTACCAGCT
GGTGGGAAATGGTCAGGTGGTCAAGAAATCACTATTGGCGGTGAGATTAAAGTTCAAGCTAATATTTAT
TAG YMR099C_homolog 299aa(SEQ ID NO 572)
MPVEELEDRVIITDPNDSTNRATILKFGATVVSWKNNNQEKLWLSEGAHLDGSKAVRGGIPLVFPVFGK
QKDSNHPTFKLPQHGFARNSTWEFLGQTQESPITVQFGLGPENVDPETLKLWNYDFTLILTVSLTKDKL
VTSIDVENTGKEAFEFNWLFHTYYRIHDITDTLVTNLIDQQCYDQLIGESYIEKAPVISFHEEFDRIYS
KVSLEKSIQVVDKGQVLFNLHRKNLPDSVVWNPWTKKAEGMADFQPKSGFHQMVCVEPGHVNSMVSLPA
GGKWSGGQEITIGGEIKVQANIY YBL085W_homolog 3519bp public: 1..3519(SEQ ID NO 573)
ATGGATGGTGGCGATACTTATATATGTATAAAACAATTTAATGCCAGATTAGGCGATGAATTGAGTCTT
AAAATTGGCGACAAAATTCAAGTATTGGCTGACGATAGAGAATATAATGATGGTTGGTACATGGGCAAA
AACTTGTTGACTGGAGAAGCAGGCTTATATCCAAAAACATTTACTCAATTAATAACCAACAATGATAGT
AAAACACTTCTTAGATCGAGGTCAAGAAGAATGATGGCACCTAAAAGTTCCGACCAAGAAACAACACCA
AAGGACACCACTACTCCCGTGGTGTCGAGTAATCTCAATCCCAACACTCCTCCAAATTACCCTCCAACA
TTGTCATCTTCAACAGAACCTTCCCATTTAGCTGAACCAATGTCTCAGTTAAATTTAAATAAAGATTCT
CAATCTTCTCAATATACTGGGTCTCATTTGAACAGCCAAATTGATAGAGCATTACAAGAACTTCAAGGG
TCTAATGCCGACTTGACCAATTCTGGCAATAGTTTTAATGAGCACAGAAACCACCACTACAATAACAAC
ACTAATAATAATAATAATAATAATAGTGCTACTAGTAATAATTACAAACAACCACAGTTAATG
TCGAAGAAATCAAATGATAGTCTTTCTAGTCAATATCAATATCAATCACAATCCCAACAACCAAAACAT
TTGAGTGGAGATAAATCTCGACAATCCTTAACTGACGATTTGGACCCTTTGAAAGCAAATACTTGGACA
CCAAAGCAAGTTTCTTCTTATTTTGCCTTGGTGTTAGGGTTTGATATGGATGTGGCTGGGAAATTTGCT
CAACACAAAATCACTGGAGAAATCTTGTTTGAATTGGATTTAAATCTTTTGAAAGAATTGGATATTGAT
TCATTTGGTACCAGATTCAAATTATATAAAGAAATTGGGAAATTAAAGGAATTGAATACTGAAGGAGTT
AAAGATAAACAATTGAGAACAGATTCTCTGTCGACTGGATCAACTGGTAAAAATGACACTACGTCATCA
GCATTAAATTCTCCACCAACTGCTTCCACAACTTTACACGATGCCGTGCCTCATATCGATGATAATAAT
ATGTTAAATAATAATAATAATAATAACAAACAACAACTGCCATCAGCCGTTTTGACCAACACTTCTGAC
TACAATAATAATAGTCAACAACAAAGTGGTTCTCAACATCATCAGAGGAAAAGGTCACTGTCGGTGGAT
GTTGCCCCACAACAATACTTGGCTTCTGATTCTACATTTATGTCGCCTAGAAGAGCTCCTCAACCACCA
TCTGGTGAGAGCCCAATTGATACAAGTTATAAATTGGTGCTGGAAGCGAATACGATAGACCACCTTCA
CACTATGGCATGTACATGACACGTACTAACGCTTCAAGTCATGCCTTGGGAAGTTCATCACCAGGAATC
AACTCACGACCAGCTTCATCAATTTATGATCTGTTTTCCAATCATAATAGAAATGGATCATCAACTTCA
AAACAACACCACAAGAGAAATTCATCAGTAACCAACAATAACAATAACAATAACGGTAACAGCAACCAC
AAGCATCATCACAGACGTCATTCTTCGGTATTCTCATACCTTTCGTCTGGTAATGATGATTCGGCAAAA
CCAACACCAAAATTATTGAGTAGTAAGTTCCAAAGTAACAATTTGTACAAGGGTGGTGATGATGGTCAT
GGAGATTTCACTTCTTCAAGCAATAACAACAACAATAACAGTAGTTAGTTGTCGCCAGCCAGATCAAG
AGAGAAACCACTAGTGGTCAATCGTCTCTTCATGAATCAGGATCCAAATCGAAAGGAAAATCACAAATT
TTTGATTTATCCAATTCACCAGTTGATATTGATGATGCCAAGTTTTCTCCAAAAAAACTGAATTCCGTA
TCAGTTCGCACCAAGTCAATGGATGCAATTGGTGGTAATGGAGACGATAGACGTGTTGCTAGTGATTCT
ACAGGATTGAGTCAATCAAAACCTAATAATTCATCAAGACTTAAAGGCATTCGTGCCACGTCAACTCAA AGTTTCCGAAGTTTAACAGGGTCGAAGAAACTGAAAACATCAGCATTTCAAGAAGGTATACGTGAGATT
ACTCCTGATGAAGCCATTAAAACTGCCAGTCATAGTGGTTATATGTCTAAACGTTCAAATAACAATTTA
GCGTGGAGAACAAGATATTTCACATTACACGGTACCAGATTACATATTTCCAATCTTTGAAAGATAAA
AAGGAAAAAGGTTTGATATTACTGCTCATAAAGTGATACCTATTGATAGTGCTAGTGATCATACT
GATAAAGCTGATAGATATGCTGCGATGTATGCCTCGACAACATTTGCTGGTAATTATTGTTTTAAATTG
GTTCCACCGGCTCCAGGGTTTAAAAAGGGGTTAACGTTTACGCAACCGAAAACTCATTATTTTGCTGTT
GAAACAGAAGAAGAAATGAGAGCTTGGGTCAAAGCATTAATGCAAGCCACTATTGATATTGATGATTCT
GTTCCTGTTGTGAGTAGTTGTTCTACCCCAACTGTCAGTTTGAATAAAGCTCAAGAATTGTTAGCTAAA
GCCAGAGAAGAAACCAAATTACGAGATGAACAACTAAAAGCTAATGGCTACATTAGAAGCTTAGAAGAT
ATCAATGATACTTCATTTCTGGCATCTTTGGATTATCCTGATATGAGTGGAGATATTGGTTTTGGTAGT
ACTTCTCCAGTAGCAGCAACTTCAGCACCTAAATTGACTCTTGATACTAATTTTAATAGGAAAAGTTCT
GGAACTATGGGAACAACGGGGACAATAGGTACTCCAGGAACATCAGGTGGTACGGTACCAACAACACCA
CAAATACCACGATCATCAAGTCAAAGTGGTGGGTTTGCTTCACCTTATTTATTAGCTTCTGGGTTATTA
TCACCCAAATCAGGAGGTGGTGCCGGTCCAGGAGGAATTGTATCATCGTCTTCTCCAATTAATGAAAAT
GGACCTTTAAGAAATTCAACTTCAAATTCAGAATATTTTGGTGATATTACTTATAAAAGTTTAAAACCA
CCATCTCGACAAAATTCCCAATATGCAAGTATCACTAGTGGTGGTGGCAGTATTGGGTTTGGATATGGT
TCCAACAATAGTGGCCTAGGTGGACCAGCAACAGCAATTGGAGGAGGAGGAGGAGTATTATCATCA
TCCACTCCATATTCTACTGGTTCTGGATCAACAGCAAGTTCAATGAATTATAATAATCATAACAACAAC
AACAACAACAACAATTCTGTTAATAGTCCGATTAATGAATTTAGATCTTCAAGGGATTTGAAATCATCA
TCGTCACCAACGACAACAACAGGTACATCTTCAACATCAGGGAAAAAACCCCAATCACGTAGAACATCA
GATAAAATGTTGGGATTTTCAAGTGATGCTTCAGGTAGTCATACTTTTGTTATTAAACCGAAAAAATAA YBL085W_homolog 1172aa(SEQ ID NO 574)
MDGGDTYICIKQFNARLGDELSLKIGDKIQVLADDREYNDGWYMGKNLLTGEAGLYPKTFTQLITNNDS
KTLLRSRSRRMMAPKSSDQETTPKDTTTPVVSSNLNPNTPPNYPPTLSSSTEPSHLAEPMSQLNLNKDS
QSSQYTGSHLNSQIDRALQELQGSNADLTNSGNSFNEHRNHHYNNNTNNNNNNNNAATSNNYKQPQLM
SKKSNDSLSSQYQYQSQSQQPKHLSGDKSRQSLTDDLDPLKANTWTPKQVSSYFALVLGFDMDVAGKFA
QHKITGEILFELDLNLLKELDIDSFGTRFKLYKEIGKLKELNTEGVKDKQLRTDSSSTGSTGKNDTTSS
ALNSPPTASTTLHDAVPHIDDNNMLNNTGKQQTQLMPSAVLTNTSDYNNNSQQQSGSQHHQRKRSSSVD
VAPQQYLASDSTFMSPRRAPQPPSGESPIDTSYKFGAGSEYDRPPSHYGMYMTRTNASSHALGSSSPGI
NSRPASSIYDSFSNHNRNGSSTSKQHHKRNSSVTNNNNNNNGNSNHKHHHRRHSSVFSYLSSGNDDSAK
PTPKLLSSKFQSNNLYKGGDDGHGDFTSSSNNNNNNSKLVSPAQIKRETTSGQSSLHESGSKSKGKSQI
FDLSNSPVDIDDAKFSPKKSNSVSVRTKSMDAIGGNGDDRRVASDSTGLSQSKPNNSSRLKGIRATSTQ
SFRSLTGSKKSKTSAFQEGIREITPDEAIKTASHSGYMSKRSNNNLAWRTRYFTLHGTRLSYFQSLKDK
KEKGLIDITAHKVIPIDSASDDTDKADRYAAMYASTTFAGNYCFKLVPPAPGFKKGLTFTQPKTHYFAV
ETEEEMRAWVKALMQATIDIDDSVPVVSSCSTPTVSLNKAQELLAKAREETKLRDEQLKANGYIRSLED
INDTSFSASLDYPDMSGDIGFGSTSPVAATSAPKLTLDTNFNRKSSGTMGTTGTIGTPGTSGGTVPTTP
QIPRSSSQSGGFASPYLLASGLLSPKSGGGAGPGGIVSSSSPINENGPLRNSTSNSEYFGDITYKSLKP
PSRQNSQYASITSGGGSIGFGYGSNNSGLGGPATAIGGGGGGVLSSSTPYSTGSGSTASSMNYNNHNNN
NNNNNSVNSPINEFRSSRDLKSSSSPTTTTGTSSTSGKKPQSRRTSDKMLGFSSDASGSHTFVIKPKK YBR019C_homolog 2028bp public: 1..2028(SEQ ID NO 575)
ATGTCAAACGAATATATTCTTGTTACTGGTGGTGCAGGTTACATTGGTTCTCATACAGTTATTGAATTA
ATCAGTAATGGATATAAAGTAGTCATTGTTGATAATTTAAGTAATTCTTCCTATGATGCAGTTGCTAGA
ATTGAATTCATTGTCAAACAACATGTTCCATTCTATGATGTTGATATCAGAAATTATGAGCAATTGAAT
AAAGTTTTCCAAGATTATAAGATCTCTGGAGTCATTCATTTTGCTGCTTTGAAAGCTGTTGGTAATCA
ACAAAAATCCCCTTAGCATATTATGATAATAATGTATCAGGTACTGTCAACTTATTGGAAGTATGTAAA
GCCAATGATGTGAAGACAATTGTTTTCAGTTCTTCAGCTACTGTCTATGGTGATGTTACTAGATTGGT
GATAATTCAATGATTCCTATCCCTGAACATTGTCCAATGGATCCAACAACTCATATGGAAGAACAAAA
TTCATTATTGAGTCGATTTTAAAAGATATTTATAATAGTGATGATGCCTTGGAAAGTAGCAATTTTGAGA
TATTTCAACCCAATTGGTGCTCATCCATCTGGTTTATTAGGTGAAGATCCATTGGGGATCCCAAATAAC
TTATTACCTTATTTGGCTCAAGTTGCTATAGGTAGACGTGAAAAATTGTCTATTTTCGGAAATGATTAT
AATAGTCGTGATGGTACCCCTATTAGAGACTATATTCATGTGGTTGATTTGGCAAAGGGTCACATTGCT
GCATTGGCGTATTTGAAAAACTTGCAATCTAAAGGCTTGTATCGTGAATGGAATTTAGGTACTGGTAAA
GGATCCACTGTTTTTGAAGTTTATCATGCATTTAGTAAAGTTGTTGGTAGAGAATTGCCCCATGAAGTT
GTTGGAAGACGTGCTGGGGATGTCTTGGATTTGACTGCTAAGCCAGACAGAGCAAACAAGGAATTGCAA
TGGAAAACTGAACTTACCATTGATGATGCTTGTAAAGATTTATGGAAATGGACTACTGAAGAACCCTTTT
GGATTCAACATTGAGAATTATTCTTGGAAGAATTTGATGGGTTCAATAACCGTTTGCACACCTTTGTT
GCTGGTGACTTGAAAGTTAACTTAGCGAATCGTGGTGCATTGATCCAAGCTATCACGTTGAAGGATTCC
AATATGGTCAAAGCTTATAATAATGCTGAAGATTTCAAATCTGAAACTAACCCATTTTCGGTACCACT
GTTGGTAGATATGCCAATAGAATTTCCAATGGAGAATTTAAATTGAATGGAAAAGTGTACAAATTAACT
AAAAATGAAGGAGCAAACAACTTGCATGGTGGTGCAAATGGATTCGATAAACAAGATTTCTTTGGTCCA
GTTGTGAAAAGTCGTGATGGTAAGTTTTTCGTTGATTTCTTGTTGGTTGATAAAGATGGTAATGATGGG

```
TTCCCAGGTGAGCTTGAAGCTATCGTACATTACACAATTGATGACTCCTCAGTGGAAATTGAATATGAA
TGTCAATTATTATCTGGTGAAGCAACAATTGTCAATATGACTAACCATAGTTATTTCAATGTTTCCAAC
TCAGACACTATTGAAGGAACCGAGGTAAAATTGATTACTGATAAAATGTTAGAAGTGGATTCACAATTA
TTACCAACTGGTAAATTTATTGAAAATGAAAAAGCTGCTAGCCCAATTGTGTTAAATGAGAATGACGTA
TTTGACAATTGTTTTATTGTTGATGAAGAATGTGGTATAGATACTCGTGATAAACCTTTGAAACAAGTC
TTTGAAGCAACTAGTTTTGTCACAAACAACAAATTGAAGATATCCACCACTGAACCAGCTTTCCAATTT
TACACTGGTGACGGTGTTAATACTAAAGGTTTTGGGAAAAGATGTGGTTTCTGCGTGGAACCAAGTAGA
TTTATTAATGCAATCAATCACAAAGAATGGTCTAATCAAGTCATCTTGAAAAAAGGTGATGTTTATGGA
AGTAAAATTAAATATGAATTTCAATAG

YBR019C_homolog 675aa(SEQ ID NO 576)
MSNEYILVTGGAGYIGSHTVIELISNGYKVVIVDNLSNSSYDAVARIEFIVKQHVPFYDVDIRNYEQLN
KVFQDYKISGVIHFAALKAVGESTKIPLAYYDNNVSGTVNLLEVCKANDVKTIVFSSSATVYGDVTRFG
DNSMIPIPEHCPMDPTNPYGRTKFIIESILKDIYNSDDAWKVAILRYFNPIGAHPSGLLGEDPLGIPNN
LLPYLAQVAIGRREKLSIFGNDYNSRDGTPIRDYIHVVDLAKGHIAALAYLKNLQSKGLYREWNLGTGK
GSTVFEVYHAFSKVVGRELPHEVVGRRAGDVLDLTAKPDRANKELQWKTELTIDDACKDLWKWTTENPF
GFNIENYSWKEFDGFNNRLHSFVAGDLKVNLANRGALIQAITLKDSNMVKAYNNAEDFKSETNPFFGTT
VGRYANRISNGEFKLNGKVYKLTKNEGANNLHGGANGFDKQDFFGPVVKSRDGKFFVDFLLVDKDGNDG
FPGELEAIVHYTIDDSSVEIEYECQLLSGEATIVNMTNHSYFNVSNSDTIEGTEVKLITDKMLEVDSQL
LPTGKFIENEKAASPIVLNENDVFDNCFIVDEECGIDTRDKPLKQVFEATSFVTNNKLKISTTEPAFQF
YTGDGVNTKGFGKRCGFCVEPSRFINAINHKEWSNQVILKKGDVYGSKIKYEFQ YCR005C_homolog 1194bp public: 1..1194(SEQ ID NO 577)
ATGAGAGGTATCAAAGGTTTAGTTTGGGAAGGTTCTGTTTTGGACCCAATTGAAGGTATCCGTTTCAGA
GGAAGAACCATCCCAGACATTCAAAAGAATTGCCAAAAGCACCAGGTGGTGAAGAACCATTACCAGAA
GCTCTTTTCTGGTTGTTGTTGACTGGTGAAGTTCCAACTGACGCCCAAACTAAGGCTTTATCCGAAGAA
TTTGCTGCTAGATCAGCATTACCAAAGCACGTTGAAGAATTGATCGACAGATCTCCATCTCACTTGCAC
CCAATGGCTCAATTCTCCATTGCCGTTACTGCTTTGGAATCTGAATCCCAATTTGCCCAAGCTTATGCT
AAAGGTGCCAACAAATCCGAATACTGGAAATACACTTACGAAGATTCCATCGATTTGTTAGCTAAATTG
CCAACCATTGCTGCTAAGATTTACAGAAACGTTTTCCACGATGGTAAATTGCCAGCTGCCATTGACTCC
AAATTGGATTACGGTGCTAACTTGGCCAGTTTGTTAGGTTTTGGTGACAACAAGGAATTTGTTGAATTA
ATGAGATTGTACCTTACCATCCACTCTGACCACGAAGGTGGTAACGTCTCTGCACACACCACCCACTTG
GTTGGTTCCGCTTTATCTTCCCCATTCTTGTCATTAGCTGCTGGTTTGAATGGTTTAGCTGGTCCATTA
CACGGTAGAGCTAACCAAGAAGTTTTGGAATGGTTGTTCAAATTAAGAGAAGAATTAAACGGTGACTAC
TCCAAGGAAGCCATTGAAAAATACTTGTGGGAAACCTTGAACTCCGGTAGAGTTGTCCCAGGTTACGGT
CACGCTGTCTTGAGAAAGACCGATCCAAGATACACTGCTCAAAGAGAATTTGCTCTTAAACATATGCCA
GACTACGAATTGTTCAAATTGGTTTCAAACATTTACGAAGTCGCTCCAGGTGTTTTGACCAAACACGGT
AAGACCAAGAACCCATGGCCAAATGTGGACTCCCACTCTGGTGTCTTGTTACAATACTACGGTTTGACT
GAACAATCTTTCTACACTGTCTTGTTCGGTGTTTCCAGAGCCTTTGGTGTCTTGCCACAATTGATCTTG
GACCGTGGTATCGGTATGCCAATTGAAAGACCAAAATCTTTCTCCACTGAAAAATACATTGAATTGGTC
AAAAACATCAACAAAGCTTAA YCR005C_homolog 397aa(SEQ ID NO 578)
MRGIKGLVWEGSVLDPIEGIRFRGRTIPDIQKELPKAPGGEEPLPEALFWLLLTGEVPTDAQTKALSEE
FAARSALPKHVEELIDRSPSHLHPMAQFSIAVTALESESQFAQAYAKGANKSEYWKYTYEDSIDLLAKL
PTIAAKIYRNVFHDGKLPAAIDSKLDYGANLASLLGFGDNKEFVELMRLYLTIHSDHEGGNVSAHTTHL
VGSALSSPFLSLAAGLNGLAGPLHGRANQEVLEWLFKLREELNGDYSKEAIEKYLWETLNSGRVVPGYG
HAVLRKTDPRYTAQREFALKHMPDYELFKLVSNIYEVAPGVLTKHGKTKNPWPNVDSHSGVLLQYYGLT
EQSFYTVLFGVSRAFGVLPQLILDRGIGMPIERPKSFSTEKYIELVKNINKA YDR345C_homolog 1653bp public: 1..1653(SEQ ID NO 579)
ATGTCATTAGATAATTCAACAGAAACCGTGATTTGGAAGAAAAGGAAGAAATTCCAAAGAACGAACAT
AACGAACAAGGCGAACAAAACGAGAACAATGAGCATATACCTACTTTGGAAGATAAACCATTGAAGGAA
TATATTGGTATTAGTATTTTGTGTTTCCTTATTGCCTTTGGTGGTTTCGTTTTCGGTTTCGATACTGGT
ACCATTTCTGGTTTCATTAACATGACTGACTTTTTAGAAAGATTTGGTGGTACTAAAGCTGACGGTACT
CTTTACTTTTCCAACGTTAGAACTGGTTTATTGATTGGTTTGTTCAATGTGGGTTGTGCCATTGGTGCA
TTATTCTTGTCTAAAGTCGGTGATATGTATGGTAGAAGAGTTGGTATCATGACTGCTATGATCATTTAT
ATTGTTGGTATTATTGTTCAAATTGCTTCTCAACATGCTTGGTATCAAATCATGATTGGTAGAATTATC
ACTGGTCTTGCTGTTGGTATGTTATCAGTTTTGTGTCCATTATTTATCTCAGAGGTTTCTCCCAAACAT
TTAAGAGGTACATTAGTTTATTGTTTCCAATTGATGATTACCTTGGGTATTTTCTTGGGTTACTGTACC
AGTTACGGTACTAAGAAATATTCTGACTCCAGACAATGGAGAATTCCATTGGGTTTATGCTTTGCTTGG
GCCTTGTGTTTGCTTGGTGGTATGGTAAGAATGCCAGAATCTCCACGTTACCTTGTCGGTAAAGATAGA
ATTGACGATGCTAAGATTTCACTTGCCAAAACTAACAAGGTTTCTCCAGAGGACCCTGCATTATACCGT
```

```
GAACTTCAATTAATCCAAGCTGGTGTTGAAAGAGAAAGATTGGCCGGTAAGGCATCTTGGGGTGCTTTA
ATCACTGGTAAACCAAGAATCCTTGAAAGAGTTATTGTTGGAGGTATGTTGCAATCATTGCAACAATTG
ACTGGTGATAACTATTTCTTCTACTACAGTACCACCATTTTCAAGTCTGTCGGTTTAAATGATTCCTTC
GAAACATCTATTATCCTTGGTGTCATCAACTTTGCTTCCACTTTTGTTGGTATTTATGCCATTGAAAGA
TTGGGTAGAAGACTCTGTTTATTAACTGGTTCCGTTGCCATGTCCATTTGTTTCTTAATTTACTCATTG
ATTGGTACTCAACATCTTTACATTGATCAACCAGGTGGTCCAACCAGAAAACCAGATGGTAACGCTATG
ATTTTCATTACTGCACTTTATGTTTTCTTCTTCGCTTCTACATGGGCTGGTGGTGTCTACTCCATTGTT
TCTGAACTTTATCCATTAAAAGTCAGAAGTAAGCCTATGGGTTTTGCTAATGCATGTAACTGGTTGTGG
GGTTTCTTGATTTCCTTCTTCATTTATCACTGATGCTATCCACTTCTATTATGGTTTTGTGTTT
ATGGGCTGTTTAGTGTTTTCCATTTTCTTTGTTTACTTTATGATTTACGAAACTAAAGGTCTTACTTTA
GAGGAAATTGATGAATTATACTCTACCAAGGTTGTTCCATGGAAATCAGCCGGTTGGGTTCCACCTTCT
GACGAAGAAATGGTTCGTGCAAAAGGCTATACTGGTGATATCCACGCAGATGAAGAGCAAGTTTAA

YDR345C_homolog 550aa(SEQ ID NO 580)
MSLDNSTENRDLEEKEEIPKNEHNEQGEQNENNEHIPTLEDKPLKEYIGISILCFLIAFGGFVFGFDTG
TISGFINMTDFLERFGGTKADGTLYFSNVRTGLLIGLFNVGCAIGALFLSKVGDMYGRRVGIMTAMIIY
IVGIIVQIASQHAWYQIMIGRIITGLAVGMLSVLCPLFISEVSPKHLRGTLVYCFQLMITLGIFLGYCT
SYGTKKYSDSRQWRIPLGLCFAWALCLLGGMVRMPESPRYLVGKDRIDDAKISLAKTNKVSPEDPALYR
ELQLIQAGVERERLAGKASWGALITGKPRILERVIVGGMLQSLQQLTGDNYFFYYSTTIFKSVGLNDSF
ETSIILGVINFASTFVGIYAIERLGRRLCLLTGSVAMSICFLIYSLIGTQHLYIDQPGGPTRKPDGNAM
IFITALYVFFFASTWAGGVYSIVSELYPLKVRSKAMGFANACNWLWGFLISFFTSFITDAIHFYYGFVF
MGCLVFSIFFVYFMIYETKGLTLEEIDELYSTKVVPWKSAGWVPPSDEEMVRAKGYTGDIHADEEQV YDR545W_homolog 1194bp public: 1..1194(SEQ ID NO 581)
ATGGCATCCGAAGGTATTACTGAAATCGACTCTGGTTTAATTGAAACCAATTACGATAACGTCGTCTAC
AAGTTCGACGATTTAAACTTGAAACCAAACATTGTTAGAGGTATTTTTGGTTACGGGTATGAAACTCCA
TCCGCTATTCAACAAGAGCCATCTTGCCAATCACTGAAGGTAGAGATGTTTTGGCTCAAGCTCAATCC
GGTACTGGTAAAACCGCTACCTTTACCATTTCTGCATTACAAAGAATCAATGAAAATGAAAAAGCCACT
CAAGCTTTAATCTTGGCCCCAACCAGAGAATTGGCTTTGCAAATCAAGAATGTTATCACTGCTATTGGT
TTGTACTTGAAGGTTACTGTCCATGCTTCTATTGGTGGTACCTCAATGAGTGACGATATTGAAGCTTTC
AGATCTGGTGTTCAAATTGTCGTTGGTACTCCAGGTAGAGTCTTAGACATGATTGAAAGAAGATATTTC
AAAACCGATAAAGTCAAGATGTTCATTTTGGATGAAGCTGATGAAATGTTATCAAGTGGATTTAAAGAA
CAAATTTACAACATTTTCAGATTATTACCAGAAACCACCCAAATTGTCTTATTATCTGCCACCATGCCA
CAAGACGTTTTGGAAGTCACCACCAAATTCATGAACAACCCAGTCAGAATCTTAGTCAAAAAGATGAA
TTGACTTTGGAAGGTATCAAACAATTCTATATTAATGTTGAATTAGAAGATTACAAATTCGATTGTTTG
TGTGATTTGTACGATTCTATTTCTGTCACCCAAGCCGTCATTTTCTGTAACACTAGATCCAAGGTTGAA
TTTTTAACCAACAAATTGAGAGAACAACACTTTACTGTCTCTGCCATCCACGCTGATTTGCCACAAGCC
GAAAGAGACACCATTATGAAAGAATTCAGATCTGGTTCTTCAAGAATCTTGATCTCTACTGATTTGTTA
GCTAGAGGTATTGATGTCCAACAAGTTTCTTTAGTTATCAACTACGATTTGCCAGCCAACAAGGAAAAC
TACATTCATAGAATTGGTAGAGGTGGTCGTTTCGGTAGAAAGGGGGTTGCCATCAACTTTGTCACTGAC
AGAGATGTTGGTATGATGAGAGAAATTGAAAAATTCTACTCTACTCAAATCGAAGAAATGCCAGCTGAT
ATTGGTGCTTTATTTGCTTAG YDR545W_homolog 397aa(SEQ ID NO 582)
MASEGITEIDSGLIETNYDNVVYKFDDLNLKPNIVRGIFGYGYETPSAIQQRAILPITEGRDVLAQAQS
GTGKTATFTISALQRINENEKATQALILAPTRELALQIKNVITAIGLYLKVTVHASIGGTSMSDDIEAF
RSGVQIVVGTPGRVLDMIERRYFKTDKVKMFILDEADEMLSSGFKEQIYNIFRLLPETTQIVLLSATMP
QDVLEVTTKFMNNPVRILVKKDELTLEGIKQFYINVELEDYKFDCLCDLYDSISVTQAVIFCNTRSKVE
FLTNKLREQHFTVSAIHADLPQAERDTIMKEFRSGSSRILISTDLLARGIDVQQVSLVINYDLPANKEN
YIHRIGRGGRFGRKGVAINFVTDRDVGMMREIEKFYSTQIEEMPADIGALFA YIL057C_homolog 606bp public: 1..606(SEQ ID NO 583)
ATGGCGGGAAAGAAAAAGTCTAAGTCTGAAGCTTTACCATTAGATTTAGACAATATTAAACCAATGGAT
CATTTACAACCAGTCCCTAAAACAAGATCATCATCAATTACCTCAATTGAAAGTGCTGATGAACCAGGT
ACTATGAAACAAGTGTTGTTACCACCTACAATCAAAGAATTTGACGAATTGGAACAATTTGAATCATTT
GTTCGTGATGAAACTTGGGATAATGATTTTGATTATTTCCATGGTAGATTACATTATTATCCACCATTT
GTTATGAAGAGTTGTCAAAATAATCTTGAAAAAATCAAGCCTACCATGAATAAAAACTCCAAGAAATTT
AGACGTGATTTACAACATCATATTCAAAAACATTTAATTAAAGATTTAGAAAATGTTGTGGTTACGAG
TTGAATTTTGGTAAAGGAGAAGTTGTTGAGACTGATAATAAAGTTACTTGGAAATTTAAAGACGAAACT
GATCATGGTTTTAGTAAAGAAGAAGAAGATATGTATGATAGACATTGGAGATTGGAATTGGATGTTTCT
TGTACAAATGAATCAGCTATGGTTGATGTTAATATAAATCCATTCCAATGTAA
```

YIL057C_homolog 201aa(SEQ ID NO 584)
MAGKKKSKSEALPLDLDNIKPMDHLQPVPKTRSSSITSIESADEPGTMKQVLLPPTIKEFDELEQFESF
VRDETWDNDFDYFHGRLHYYPPFVMKSCQNNLEKIKPTMNKNSKKFRRDLQHHIQKHLIKDLEKCCGYE
LNFGKGEVVETDNKVTWKFKDETDHGFSKEEEDMYDRHWRLELDVSCTNESAMVDVEYKSIPM YKR097W_homolog 1662bp public: 1..1662(SEQ ID NO 585)
ATGGCTCCTCCTACTGCTGTTGAATCTTCAATTTCGGAGGTCACCCAACTATCAAATCCACTCAA
GACCCATTGGTCCAAAAGTTGTCTCTTAATACCGACACTGTGATCAGACACAATGCTCCACCTCCAACC
TTATACGAAGATGGTTTATTAGAAAAAGGTACTACTATCTCATCTACTGGTGCTTTAATGGCTTACTCT
GGTAACAAAACCGGTAGATCTCCTAAAGACAAGAGAATTGTCGACGAATCCACCTCATCCCATAACATT
TGGTGGGGTCCAGTGAATAAACAAGTTGACGAATTAACTTGGAAGATTTCTAGATCAAGAGCTTTGGAT
TACTTGAGAACTAGAGAAAAGTTGTTTGTTGTTGACGCTTATGCTGGTTGGGATCCAAGATACAGAATC
AAGGTCAGAATTATCTGTGCTAGAGCTTACCATGCTTTGTTCATGACCAATATGTTGATCAGACCAACT
GAAGAAGAATTAAAAAACTTTGGTGAACCAGATTTCACCATCTACAATGCTGGTCAATTCCCAGCCAAC
ATCCACACTAAAGGTATGACTTCTGCCACTTCTGTTGAAATCAACTTTAAAGATATGGAAATGGTTATC
TTGGGTACTGAATATGCTGGTGAAATGAAGAAAGGTATCTTTACTGTTATGTTCTACTTGATGCCAATC
AAACACAAGGTTTTGACTTTGCACTCCTCATGTAACCAAGGGGTTGAAAAAGGTGATGTCACTTTGTTC
TTTGGTCTTTCTGGTACTGGTAAGACCACTTTGTCTGCTGATCCACAAAGAAAGTTGATTGGTGATGAC
GAACATTGTTGGTCCGACAATGGTGTGTTCAACATTGAAGGTGGTTGTTACGCCAAATGTTTGGACTTG
TCTGCTGAAAAAGAACCAGAAATTTTCAACTCCATCAAGTTTGGTGCTATTTTGGAAAATGTTGTCTAC
GACCCAATCACCAAGGTTGTTGACTACGAAGATTCATCAATCACTGAAAACACTAGATGTGCATACCCA
ATTGATTTCATTCCATCTGCCAAGATTCCATGTTTGGCCGACACCCATCCAACCAATATTATCTTGTTA
ACATGTGATGCTTCCGGTGTGTTGCCACCAGTCTCCAAATTGACTAATGCTCAAGTTATGTATCATTTC
ATTTCTGGTTACACCTCCAAGATGGCAGGTACTGAAGAAGGTGTTACTGAACCACAAGCTACATTCTCC
GCATGTTTCGGTCAACCATTCTTGGTGTTGCACCCAATGAAATATGCTCAACAATTGTCTGACAAGATT
TCCGAACACAATGCCAACGCTTGGTTGTTGAACACTGGTTGGGTTGGTTCTTCTGTTGCTCAAGGTGGT
AAGAGATGTCCATTGAAATACACCAGAGCTATCTTGGATGCTATCCACTCTGGTGAATTGTCTAAAGTC
GAATACGAAAAAGTTCCAGTTTTCAACCTTAATGTTCCAACTTCTTGTCCTGGTGTTCCAAGTGAAATT
TTGAACCCAACTAAAGCTTGGACCCAAGGTACTGATTCATTCAACAAGGAAATCAAATCTCTTGCTACC
AAGTTTGCTGAAAACTTCAAGACATACGCTGATCAAGCTACTGCTGAAGTTAAAGCTGCTGGTCCAGAA
GCATAA YKR097W_homolog 553aa(SEQ ID NO 586)
MAPPTAVESSINFGGHPTIKSTQDPLVQKLSLNTDTVIRHNAPPPTLYEDGLLEKGTTISSTGALMAYS
GNKTGRSPKDKRIVDESTSSHNIWWGPVNKQVDELTWKISRSRALDYLRTREKLFVVDAYAGWDPRYRI
KVRIICARAYHALFMTNMLIRPTEEELKNFGEPDFTIYNAGQFPANIHTKGMTSATSVEINFKDMEMVI
LGTEYAGEMKKGIFTVMFYLMPIKHKVLTLHSSCNQGVEKGDVTLFFGLSGTGKTTLSADPQRKLIGDD
EHCWSDNGVFNIEGGCYAKCLDLSAEKEPEIFNSIKFGAILENVVYDPITKVVDYEDSSITENTRCAYP
IDFIPSAKIPCLADTHPTNIILLTCDASGVLPPVSKLTNAQVMYHFISGYTSKMAGTEEGVTEPQATFS
ACFGQPFLVLHPMKYAQQLSDKISEHNANAWLLNTGWVGSSVAQGGKRCPLKYTRAILDAIHSGELSKV
EYEKVPVFNLNVPTSCPGVPSEILNPTKAWTQGTDSFNKEIKSLATKFAENFKTYADQATAEVKAAGPE
A YOL126C_homolog 1014bp public: 1..1014(SEQ ID NO 587)
ATGGTCAAAGTCGCTATTTTAGGAGCTGCTGGTGGTATTGGTCAACCATTATCTTTATTGACCAAATTA
AACCCAAATGTTGATGAATTGGCATTATTTGATGTCGTCAATGTTCCAGGAGTTGGTGCTGATTTATCT
CATATCAATTCTGATTCTAAAACTCAATCATATATTTACCAAAAGATAAAGAAGATAAAACTGCATTAGCT
GCTGCATTAAAAGGTTCTGATTTAGTCATTATCCCAGCTGGTGTTCCAAGAAAACCAGGTATGACCAGA
GATGATTTATTCAATATTAATGCATCAATCGTTCAAGGTTTAGCTGAAGGTATTGCTGCCAATTCTCCA
AAAGCTTTTGTCTTGGTGATTTCTAATCCAGTCAATTCTACTGTACCAATTGTTGCCGAAACTTTACAA
GCTAAAGGTGTTTATGATCCAGCTAGATTATTTGGTGTTACTACTTTGGATATTGTTAGAGCCAATACT
TTTATTTCTCAATTATTCCTAGATCAAACTAAACCATCTGATTTCAATATTAATGTTGTTGGTGGCCAT
TCTGGTGAAACCATTGTTCCATTATATTCATTAGGTAACTCTAAACAATATTATGATATATTATCTGAA
GAACAAAAGAAGGAATTAATCAAAAGAGTTCAATTTGGTGGCGATGAAGTTGTTCAAGCCAAGAATGGT
GCTGGTTCCGCCACTTTATCCATGGCTTATGCCGGTTATAGATTAGCCGAATCAATTTTAGCTGCTGTT
AATGGTAAAACTGATATTGTTGAATGTACTTTCTTGAACTTGGATTCTTCAATTAAAGGTGCTTCTGAA
GCTAGAAAATTGGTTAAAGATTTAGATTTCTTTTCATTACCAGTTCAATTAGGTAAAAACGGTATTACT
GAAGTTAAATATGATATCTTAAATCAAATTTCTGATGATGAAAAGAAATTGTTAGAAGTTGCCATTGAA
CAATTACAAAAGAATATTGAAAAAGGTGTTTCATTTGCTAAGAAATAA YOL126C_homolog 337aa(SEQ ID NO 588)
MVKVAILGAAGGIGQPLSLLTKLNPNVDELALFDVVNVPGVGADLSHINSDSKTQSYLPKDKEDKTALA
AALKGSDLVIIPAGVPRKPGMTRDDLFNINASIVQGLAEGIAANSPKAFVLVISNPVNSTVPIVAETLQ
AKGVYDPARLFGVTTLDIVRANTFISQLFLDQTKPSDFNINVVGGHSGETIVPLYSLGNSKQYYDILSE
EQKKELIKRVQFGGDEVVQAKNGAGSATLSMAYAGYRLAESILAAVNGKTDIVECTFLNLDSSIKGASE
ARKLVKDLDFFSLPVQLGKNGITEVKYDILNQISDDEKKLLEVAIEQLQKNIEKGVSFAKK YBL072C_homolog 621bp public: 1..621(SEQ ID NO 589)
ATGGGTATTTCTAGAGATTCACGTCACAAAAGATCCGCCACTGGTGCCAAAAGAGCCCAATTCAGAAAG
AAGAGAAAGTTTGAATTAGGTAGACAACCAGCCAACACCAAGATTGGTCCAAAAAGAATTCACTCTGTC
AGAACCAGAGGTGGTAACCAAAAATTCAGAGCTTTGAGAGTTGAAACCGGTAACTTCTCTTGGGGTTCC
GAAGGTGTTTCCAGAAAAACCAGAATTGCTGGTGTCGTTTACCATCCATCTAATAACGAATTGGTTAGA
ACCAACACCTTGACCAAATCTGCTGTTGTTCAAATTGATGCTACTCCATTCAGACAATGGTACGAAAAC
CACTACGGTGCTACTTTAGGTAAAAAGAAGGGTGGTGCTCATGCTGCTCACGCTGCTGAAGTTGCCGAT
GCCAAGAGATCAAGAAAAGTCGAAAGAAAATTGGCTGCTAGATCTGGTGCTGCTGCCATTGAATCCGCT
GTTGACTCTCAATTCGGTTCTGGTAGATTATACGCTGTCATTTCTTCAAGACCAGGTCAATCTGGTAGA
TGTGATGGTTACATCTTGGAAGGTGAAGAATTAGCCTTCTACTTGAGAAGATTAACTGCTAAGAAATAA YBL072C_homolog 206aa(SEQ ID NO 590)
MGISRDSRHKRSATGAKRAQFRKKRKFELGRQPANTKIGPKRIHSVRTRGGNQKFRALRVETGNFSWGS
EGVSRKTRIAGVVYHPSNNELVRTNTLTKSAVVQIDATPFRQWYENHYGATLGKKKGGAHAAHAAEVAD
AKRSRKVERKLAARSGAAAIESAVDSQFGSGRLYAVISSRPGQSGRCDGYILEGEELAFYLRRLTAKK YBR009C_homolog 318bp public: 1..318(SEQ ID NO 591)
ATGTCAGGTACCGGTAGAGGAAAAGGTGGTAAAGGTTTAGGAAAAGGTGGTGCTAAACGTCACAGAAAA
ATTTTAAGAGATAACATTCAAGGTATTACAAAACCAGCTATCAGAAGATTGGCCAGAAGAGGTGGTGTT
AAACGTATTTCTGCTTTGATTTATGAAGAAGTCAGAGTTGTCTTGAAACAATTTTTGGAAAACGTTATC
AGAGATGCTGTTACTTACACTGAACATGCTAAAAGAAAAACCGTCACTTCATTGGATGTTGTTTACGCT
TTGAAGAGACAAGGTAGAACCTTGTATGGTTTCGGTGGTTAA YBR009C_homolog 105aa(SEQ ID NO 592)
MSGTGRGKGGKGLGKGGAKRHRKILRDNIQGITKPAIRRLARRGGVKRISALIYEEVRVVLKQFLENVI
RDAVTYTEHAKRKTVTSLDVVYALKRQGRTLYGFGG YBR189W_homolog 489bp public: 1..489(SEQ ID NO 593)
ATGGCCGGTGAATACCGGTTTAAAAAACAAGGGGGGAATCTACAGAATTGGGGTTCCAAATGTCCTAAA
ATCAGAAGAGCTGCTCGTGAATTTGTAACCAGAGGTGAAAAAGGCCCCAAAAAGATTATTCGGAAGGTA
ATGGCTTTGATCAGAAGATTAGTCAGATTCGGTTTCTTGTCTGAGGACAAAATGAAATTGGATTATGTC
TTGGCTTGGAACCCAGAAGTTTTTCTTAACAGAAGATTCCAACCCCAAGTTTTTCAAATTAGGTTTAGCT
AGATCTATCCCCCACGCCAGAGTTTTGCACCCAAAGCCACATTGCTGTTGGTAAACAAATTGTTACC
ATCCCATCATTTACTGTCAGATTGGACTCTCAAAAACACATTGACTTTGCCCACAACTCTCCATACGGT
GGTGGTAGAGCCGGTAGAGTTAAGAGAAAGAACCAAGGTAAAGGTGGTGAAGAAGGTGCCGAAGAAGAA
GAATAA YBR189W_homolog 162aa(SEQ ID NO 594)
MAGEYRFKKQGGNLQNWGSKCPKIRRAAREFVTRGEKGPKKIIRKVMALIRRLVRFGFLSEDKMKLDYV
LAWNPEVFLNRRFQPQVFKLGLARSIPHARVLITQSHIAVGKQIVTIPSFTVRLDSQKHIDFAHNSPYG
GGRAGRVKRKNQGKGGEEGAEEEE YBR191W_homolog 330bp public: 1..330(SEQ ID NO 595)
ATGCCACACAAATACTACCACGGTAAGACTGGTATTGTTTACAACGTTACCAAATCCTCCGTTGGTGTT
ATCATTAACAAAGTTGTTGGAAACAGATACATTGAAAAGAGAGTTAACTTGAGAGTTGAACATGTTAAA
CACTCTGCTTGTCGTCAAGAATTCTTGAACAGAGTTAAATCTAACGCTGCTAAAAAGAGAGAAGCTAAA
GCTAACGGTGAAACCGTTTACTTGAAGAGACAAGCTGCCAAGCCAAGAGGTTCAAGAATTATCTCCACT
GAAGGTAACATTCCTCAAACTTTGGCTCCAGTCGCTTACGAAACTTTCATTTAA YBR191W_homolog 109aa(SEQ ID NO 596)
MPHKYYHGKTGIVYNVTKSSVGVIINKVVGNRYIEKRVNLRVEHVKHSACRQEFLNRVKSNAAKKREAK
ANGETVYLKRQAAKPRGSRIISTEGNIPQTLAPVAYETFI YCL035C_homolog 384bp public: 1..384(SEQ ID NO 597)
ATGATAGACAAAATGCTGCTGATTCTTGCCTGGGGATTCAATTTGTGGTATCAACCACCTCCACCTACT
GCACAAACTGAGAAAGAAATCGAACACACTATTAACTCTCACAAGATTGTTATTTATTCTAAAACTTAT TGTCCATTTTGTGACCAAACCAAACATCTATTAAATGAACAATATCCACAAGAATCGTACGAAGTCATA
AACTTGAATATTCTCGATGACGGATTGACTATTCAGAATCAATTGTATGCTAATACTGGTCAATATATG
GTGCCCATAATCTTCATAAACGGACAACACGTTGGAGGAAATTCAGAAGTTCAGCAATTGCACACCAAT
GGGAAATTGCAAGAATTATTGAATCCTCAGAAATATTGA YCL035C_homolog 127aa(SEQ ID NO 598)
MIDKMSSILAWGFNLWYQPPPPTAQTEKEIEHTINSHKIVIYSKTYCPFCDQTKHLLNEQYPQESYEVI
NLNILDDGLTIQNQLYANTGQYMVPIIFINGQHVGGNSEVQQLHTNGKLQELLNPQKY YDL004W_homolog 486bp public: 1..486(SEQ ID NO 599)
ATGTTCAGACAAGTTTTCCGTCAAGTTACCAAACAATCATTCACTGGGGTTAAGAGAACTTATGCCACC
GAGGCCGCCGTGTCTACAGATGCTTTGAAATTATCCTTGGCATTGCCACACCAAACCTTATACAACGAC
TCCGAAGTCCAACAAGTAAACTTGCCATCTGTCAACGGTGATTTGGGTATTTTGGCCAACCACATTCCA
ATTGTCGAACAATTGAGACCAGGATTGTTAGAAATCATTTCCAAAAACGGAGACTCTGACCAATACTTT
GTCAGCGGCGGTATCGCCATGGTCCAACCAGGAAACAAGTTGACTATTTCCGCCATCGAAGCATTCAAG
ACCGACCAAATTGATCTCTCTGCCGTCAAAAACTTGATTGCCGATGCCCAAAAGAGAGCTGAATCTAGT
GATGAAAAGGTCGCTGCTGAAGCCAACATCGAATTGGAAGTGTTAGATGCTTTACAACATTTTACTAAG
TAA YDL004W_homolog 161aa(SEQ ID NO 600)
MFRQVFRQVTKQSFTGVKRTYATEAAVSTDALKLSLALPHQTLYNDSEVQQVNLPSVNGDLGILANHIP
IVEQLRPGLLEIISKNGDSDQYFVSGGIAMVQPGNKLTISAIEAFKTDQIDLSAVKNLIADAQKRAESS
DEKVAAEANIELEVLDALQHFTK YDR099W_homolog 795bp public: 1..795(SEQ ID NO 601)
ATGCCAGCCTCCCGTGAAGATTCCGTTTACCTTGCTAAATTAGCCGAACAAGCAGAACGTTATGAAGAA
ATGGTTGAAAACATGAAAGCCGTTGCTTCCTCTGGCCAAGAATTGTCTGTTGAAGAACGTAATTTATTA
TCTGTTGCTTACAAGAATGTCATTGGTGCTCGTCGTGCTTCTTGGAGAATTGTTTCATCAATTGAACAA
AAAGAAGAAGCCAAAGGAAATGAGAGCCAAGTTGCTTTGATCAGAGATTACCGTGCCAAGATTGAAGCT
GAATTGTCTAAAATTTGTGAAGATATTCTCTCTGTGTTGAGCGACCATTTAATTACATCTGCCCAAACT
GGTGAATCAAAAGTATTTTACTACAAGATGAAAGGTGATTACCACAGATACTTGGCTGAATTTGCTATC
GCTGAAAAACGTAAGGAAGCTGCTGATTTATCATTAGAGGCTTATAAAGCTGCTTCTGACGTTGCTGTG
ACCGAGTTGCCACCAACCCATCCAATCAGATTAGGTTTAGCATTGAACTTCTCTGTTTTCTACTATGAA
ATTTTGAACTCCCCAGATAGAGCTTGTCATTTAGCTAAACAAGCTTTCGATGATGCTGTTGCTGATTTA
GAAACCTTATCTGAAGATTCATACAAGGATTCAACTTTGATTATGCAATTATTGAGAGATAACTTGACT
TTATGGACCGATTTATCTGAAGCCCCAGCTGCCACTGAAGAACAACAACAATCCAGTCAAGCTCCAGCT
GCTCAACCAACAGAAGGTAAGGCTGATCAAGAATAG YDR099W_homolog 264aa(SEQ ID NO 602)
MPASREDSVYLAKLAEQAERYEEMVENMKAVASSGQELSVEERNLLSVAYKNVIGARRASWRIVSSIEQ
KEEAKGNESQVALIRDYRAKIEAELSKICEDILSVLSDHLITSAQTGESKVFYYKMKGDYHRYLAEFAI
AEKRKEAADLSLEAYKAASDVAVTELPPTHPIRLGLALNFSVFYYEILNSPDRACHLAKQAFDDAVADL
ETLSEDSYKDSTLIMQLLRDNLTLWTDLSEAPAATEEQQQSSQAPAAQPTEGKADQE YDR399W_homolog 642bp public: 1..642(SEQ ID NO 603)
ATGTCTGAATCTGAGAAAATGTACATTTCGTACAATAATATACACCAGTTATGTCAAGAAATAGCCCCT
AAGATCAAAGAATTTAAGCCTGACTTGATCATTGCTATTGGTGGCGGTGGTTTTATTCCAGCTAGAATG
TTGCGTTCCTTCTTGAAAGAACCAGGTCAACCAAACGTTAGAATTATGGCTATCATATTGTCTTTATAC
GAAGAGATTGAGAGTGAAAACGGTATTGAAAAGCCAGGTACCCAAGTTGTGCGTACTCAATGGATTGAT
TATCATCAATCTAAAATTGACTTGGTTGGTAAAAATGTGTTAATTATTGATGAGGTTGATGATACCAGA
ACCACTTTGCATTACGCAGTCAGTGAATTGAAAAAAGATGTGGAAGAGCAATCAAAAGCCAAAGGTGCA
GATCCTAAAGATACCAAGTTTGGTATTTTTGTGTTGCACGACAAGCAAAAGCAAAAGAAAGCAGAATTG
CCAGATGATATTATGAAGACTGGTAATTATTTCGCTGCTCGTTCTGTCCCAGATAGCTGGATTGCATAC
CCATGGGAGTCTACTGACATTGTTTATCATCAAATGAAAGCTGAAGAACAAGGAAACGATGTGTTCCTT
CCTTCATCCACTTTAGAGTAA YDR399W_homolog 213aa(SEQ ID NO 604)
MSESEKMYISYNNIHQLCQEIAPKIKEFKPDLIIAIGGGGFIPARMLRSFLKEPGQPNVRIMAIILSLY
EEIESENGIEKPGTQVVRTQWIDYHQSKIDLVGKNVLIIDEVDDTRTTLHYAVSELKKDVEEQSKAKGA
DPKDTKFGIFVLHDKQKQKKAELPDDIMKTGNYFAARSVPDSWIAYPWESTDIVYHQMKAEEQGNDVFL
PSSTLE YDR418W_homolog 498bp public: 1..498(SEQ ID NO 605)
ATGCCTCCAAAATTTGATCCAAATGAAGTTAAATTCCTTTACTTAAGAGCTGTTGGTGGTGAAGTTGGT
GCTTCATCTGCTTTAGCTCCAAAGATTGGTCCATTAGGTTTATCCCCAAAGAAAGTTGGTGAAGATATT
GCCAAAGCCACCAAAGAATACAAAGGTATTAAAGTTACTGTTCAATTGAGAATTCAAAACAGACAAGCT
ACTGCTTCTGTTGTTCCATCCGCTTCATCTTTAGTCATCACCGCTTTGAAAGAACCAGTCAGAGACAGA
AAGAAGGAAAAGAACGTCAAACACTCTGGTAACATTCCATTAGATGAAATCTTTGAAATTGCCAGAAAA
ATGCAACACAAATCATTCGGTAAGAATTTGGCATCTGTCTCCAAGGAAATCTTGGGTACTGCTCAATCT
GTTGGTTGTAGAGTTGATGGTAAGAACCCTCATGACATCATTGACGCCATCAACGCTGGTGAAATTGAT
GTTCCAGAAAACTAG YDR418W_homolog 165aa(SEQ ID NO 606)
MPPKFDPNEVKFLYLRAVGGEVGASSALAPKIGPLGLSPKKVGEDIAKATKEYKGIKVTVQLRIQNRQA
TASVVPSASSLVITALKEPVRDRKKEKNVKHSGNIPLDEIFEIARKMQHKSFGKNLASVSKEILGTAQS
VGCRVDGKNPHDIIDAINAGEIDVPEN YDR513W_homolog 360bp public: 1..360(SEQ ID NO 607)
ATGTTTCGTACATTATTAACCAAAAGACTATTCAATACATCAACAATGGTTTCATCTCAAGTTAAGAAC
AAGGTCGAACAATTGATCAAAACCAAACCAGTTTTCATTGCCTCCAAATCCTATTGTCCATACTGTAAG
GCTACCAAAAGCACAATTGAAGCTATAACAAAGGATGCTTACATTCTTGAATTAGACGAAGTTGACGAC
GGTGCTGAAATCCAAGAAGCATTATTGGAAATCACTGGTCAAAGAACCGTTCCAAATGTCTTTATTGGT
GGTCAACATATTGGTGGCAATTCCGATGTGCAAGCTTTGAAGTCTAGTGACAAATTAGATGACAAAATC
AAAGCTGCTTTATAA YDR513W_homolog 119aa(SEQ ID NO 608)
MFRTLLTKRLFNTSTMVSSQVKNKVEQLIKTKPVFIASKSYCPYCKATKSTIEAITKDAYILELDEVDD
GAEIQEALLEITGQRTVPNVFIGGQHIGGNSDVQALKSSDKLDDKIKAAL YEL009C_homolog 972bp public: 1..972(SEQ ID NO 609)
ATGCCTGCTACTACTCCTATTATTTATGAAGATTCTTTATTTGAATCTCAAGATTTATTTGCTTCTCCA
GTTAAACAACAACATCAAAAGGTTGATACTGTTGCTACCAAAAACGAAATTGGTTTGGAATTAAATTTA
GGTTTACCAGAAATGCAAAAGGCTTCAGAAACTGTTTCCACTCCATTTCAAATCCATTCCAGTGTATTG
GAGTCGGGTTTCAGCACCAATTTGGATGGAGTCAATGATATTGATCATACTCCAATGTTTGATGAATTG
GATTTGATTATGGACGGAGCCAAAGTCAATTCATCAGAAGATTGGGTTGCTCTTTTTGGAGATGACAAT
GATGATGGTGTTGCTATAGCTGGTGCTACTAGCAAAGAACCAATGTTATCATTGAATGAAGATAACGAG
AACAATGATGACGACGCTGATGACGCTGATGATGATGATGCTCTTGTTCCAAGAGAAGATACTATT
GAAGCTTTATTATTGGAACCATCACCAAATCGTACCATTTCTGCTGCTACTTCTGCTTCTACTTCATCA
TTAAACAGTCCAGAAAGTACTATTGCTACCACAGTCACTGCTGGTGGTGAAGTTGTTGTTGCAAGTAAA
AAGCAATTTCAATTGGTAACACCAAATCCTTCATCCACTTTACCAACACCATTATTGGATTCTAAAAAT
TCTAAAAAAGAGTTAAAGTTGATCATTTGGGTTGTGTTACCTATTCGAAAAAACATAGATCTCAACCT
TTACAACCGATTGTTGTTGATGACATTAAAGATGCTGCTGCTTTGAAAAGAGCTAAAAATACTGAAGCT
GCTAGAAGATCCAGAGCTCGTAAAATGGAAAGAATGAGTCAATTGGAAGATAAAGTTGAGAATTTGATT
AATGAAAAGCAAGCTTTACAAGATCAAGTTGAAAGATTACAAGAATTGTTAAGAGTTAATGGTATTCAA
TTTTAA YEL009C_homolog 323aa(SEQ ID NO 610)
MPATTPIIYEDSLFESQDLFASPVKQQHQKVDTVATKNEIGLELNLGLPEMQKASETVSTPFQIHSSVL
ESGFSTNLDGVNDIDHTPMFDELDLIMDGAKVNSSEDWVALFGDDNDDGVAIAGATSKEPMLSLNEDNE
NNDDDADDADDDDDALVPREDTIEALLLEPSPNRTISAATSASTSSLNSPESTIATTVTAGGEVVVASK
KQFQLVTPNPSSTLPTPLLDSKNSKKRVKVDHLGCVTYSKKHRSQPLQPIVVDDIKDAAALKRAKNTEA
ARRSRARKMERMSQLEDKVENLINEKQALQDQVERLQELLRVNGIQF YGL123W_homolog 750bp public: 1..750(SEQ ID NO 611)
ATGTCAGCTGAAGCCCCAAAAAGACAATTTGGTGATAGAAGAAGAGGTGGTAGAAGAGGTGGTAGAAGA
GATGGTGAAGAAAAAGGTTGGACTCCAGTCACCAAGTTAGGTAGATTAGTCAAAGCTGGTAAAATCACC
AGTGTTGAACAAATCTACTTGCACTCTTTGCCAGTCAAGGAATACCAAATCATTGATTTGTTATTGCCA
GACTTGAAAGATGATGTCATGAAGATCAGATCTGTCCAAAAACAAACCAGAGCTGGTCAAAGAACCAGA
ATGAAGGCTGTTGTCGTCATTGGTGACTCTAACGGTCACGTTGGTTTGGGTATCAAGACCGCTAAAGAA
GTTGCTTCTGCCATTAAAGCTGCTATTGTTATTGCCAAATTATCCATCATCCCAATCAGAAGAGGTTAC
TGGGGTTCTAACTTGGGTCAACCACACTCTTTGCCATGTAAAGTCACTGGTAAATGGGTTCCGTTGCC
GTTAGATTAATCCCAGCCCCAAGAGGTAAAGGTATTGTTGCTTCTCCAGTTGTCAAGAGATTAATGCAA
TTGGCTGGTGTTGAAGATGTCTATACTTCCTCTTCTGGTTCTACCAGAACTACCGAAAACACCTTGAAA
GCTGCTTTCGCTGCTATCGGTAACACTTACAGTTTCTTGACTCCAAACTTGTGGGCTGAAACTCCATTA
GCTGCTTCTCCATTGGAAGTTTACGCTGAAGAAGCTGCTGCTGGTAAAAAGAGATACTAA YGL123W_homolog 249aa(SEQ ID NO 612)
MSAEAPKRQFGDRRRGGRRGGRRDGEEKGWTPVTKLGRLVKAGKITSVEQIYLHSLPVKEYQIIDLLLP
DLKDDVMKIRSVQKQTRAGQRTRMKAVVVIGDSNGHVGLGIKTAKEVASAIKAAIVIAKLSIIPIRRGY
WGSNLGQPHSLPCKVTGKCGSVAVRLIPAPRGKGIVASPVVKRLMQLAGVEDVYTSSSGSTRTTENTLK
AAFAAIGNTYSFLTPNLWAETPLAASPLEVYAEEAAAGKKRY YGR209C_homolog 312bp public: 1..312(SEQ ID NO 613)
ATGGTTCACGTTGTCACTGAAGTTAACGAATTCCAAACCCTTTTAAAGGAAAACAACTTAGTTATTGTT
GACTTTTTTGCCACTTGGTGTGGTCCATGTAAAATGATTGCTCCATTATTAGAAAAATTCCAAAATGAA
TATTCTAATATTAAATTTTTGAAAATTGATGTTGATCAATTGGGTTCTTTAGCACAAGAATATAATGTT
AGTTCTATGCCAACTTTGATTTTATTCAAAAATGGTGAAGAAGTCAATCGTGTCATTGGTGCTAACCCA
GCTGCTATTAAACAAGCTTTGGCTTCTCTTGCTTAA YGR209C_homolog 103aa(SEQ ID NO 614)
MVHVVTEVNEFQTLLKENNLVIVDFFATWCGPCKMIAPLLEKFQNEYSNIKFLKIDVDQLGSLAQEYNV
SSMPTLILFKNGEEVNRVIGANPAAIKQALASLA YHR039C-B_homolog 342bp public: 1..342(SEQ ID NO 615)
ATGTCATCTGGTATCCAATCATTATTGAAAACCGAAAAAGAAGCTGCAGAAATTGTTAATGAAGCTAGA
AAATATAGAACCACACGTTTGAAGTCTGCAAAACAAGATGCTCAAGCTGAAATTGATAACTATAAAAAG
CAAAAGGAAGAAGAATTAAAAAATTTTGAAAAAGAACACGAAGGGTTAAATGAAAAGATCGATAAAGAA
GCTGATGCTGAAGTTGAAAAGGAATTGACCAGTATCAAATCCACTTTTGAAAAGAAAAAGAGTGCAGTT
GTTAAATTGTTAGTTGACGCTACTGTCAAGCCAACACCAACTTTACACATAAATGCATCTCAATAA YHR039C-B_homolog 113aa(SEQ ID NO 616)
MSSGIQSLLKTEKEAAEIVNEARKYRTTRLKSAKQDAQAEIDNYKKQKEEELKNFEKEHEGLNEKIDKE
ADAEVEKELTSIKSTFEKKKSAVVKLLVDATVKPTPTLHINASQ YJL138C_homolog 1194bp public: 1..1194(SEQ ID NO 617)
ATGGCATCCGAAGGTATTACTGAAATCGACTCTGGTTTAATTGAAACCAATTACGATAACGTCGTCTAC
AAGTTCGACGATTTAAACTTGAAACCAAACATTGTTAGAGGTATTTTTGGTTACGGGTATGAAACTCCA
TCCGCTATTCAACAAAGAGCCATCTTGCCAATCACTGAAGGTAGAGATGTTTTGGCTCAAGCTCAATCC
GGTACTGGTAAAACCGCTACCTTTACCATTTCTGCATTACAAAGAATCAATGAAAATGAAAAAGCCACT
CAAGCTTTAATCTTGGCCCCAACCAGAGAATTGGCTTTGCAAATCAAGAATGTTATCACTGCTATTGGT
TTGTACTTGAAGGTTACTGTCCATGCTTCTATTGGTGGTACCTCAATGAGTGACGATATTGAAGCTTTC
AGATCTGGTGTTCAAATTGTCGTTGGTACTCCAGGTAGAGTCTTAGACATGATTGAAAGAAGATATTTC
AAAACCGATAAAGTCAAGATGTTCATTTTGGATGAAGCTGATGAAATGTTATCAAGTGGATTTAAAGAA
CAAATTTACAACATTTTCAGATTATTACCAGAAACCACCCAAATTGTCTTATTATCTGCCACCATGCCA
CAAGACGTTTTGGAAGTCACCACCAAATTCATGAACAACCCAGTCAGAATCTTAGTCAAAAAAGATGAA
TTGACTTTGGAAGGTATCAAACAATTCTATATTAATGTTGAATTAGAAGATTACAAATTCGATTGTTTG
TGTGATTTGTACGATTCTATTTCTGTCACCCAAGCCGTCATTTTCTGTAACACTAGATCCAAGGTTGAA
TTTTTAACCAACAAATTGAGAGAACAACACTTTACTGTCTCTGCCATCCACGCTGATTTGCCACAAGCC
GAAAGAGACACCATTATGAAAGAATTCAGATCTGGTTCTTCAAGAATCTTGATCTCTACTGATTTGTTA
GCTAGAGGTATTGATGTCCAACAAGTTTCTTTAGTTATCAACTACGATTTGCCAGCCAACAAGGAAAAC
TACATTCATAGAATTGGTAGAGGTGGTCGTTTCGGTAGAAAGGGGGTTGCCATCAACTTTGTCACTGAC
AGAGATGTTGGTATGATGAGAGAAATTGAAAAATTCTACTCTACTCAAATCGAAGAAATGCCAGCTGAT
ATTGGTGCTTTATTTGCTTAG YJL138C_homolog 397aa(SEQ ID NO 618)
MASEGITEIDSGLIETNYDNVVYKFDDLNLKPNIVRGIFGYGYETPSAIQQRAILPITEGRDVLAQAQS
GTGKTATFTISALQRINENEKATQALILAPTRELALQIKNVITAIGLYLKVTVHASIGGTSMSDDIEAF
RSGVQIVVGTPGRVLDMIERRYFKTDKVKMFILDEADEMLSSGFKEQIYNIFRLLPETTQIVLLSATMP
QDVLEVTTKFMNNPVRILVKKDELTLEGIKQFYINVELEDYKFDCLCDLYDSISVTQAVIFCNTRSKVE
FLTNKLREQHFTVSAIHADLPQAERDTIMKEFRSGSSRILISTDLLARGIDVQQVSLVINYDLPANKEN
YIHRIGRGGRFGRKGVAINFVTDRDVGMMREIEKFYSTQIEEMPADIGALFA YKL060C_homolog 1080bp public: 1..1080(SEQ ID NO 619)
ATGGCTCCTCCAGCAGTTTTAAGTAAATCCGGTGTTATCTACGGTAAAGACGTCAAAGACTTGTTTGAC
TATGCTCAAGAAAAGGTTTTGCCATTCCAGCTATCAATGTCACTTCATCCTCAACTGTTGTTGCTGCT
TTAGAAGCTGCCAGAGACAACAAGGCTCCAATCATCTTGCAAACTTCTCAAGGTGGTGCTGCCTACTTT
GCCGGTAAAGGTGTCGACAACAAAGATCAAGCTGCTTCCATTGCTGGTTCAATTGCTGCCGCTCACTAC
ATTAGAGCCATTGCTCCAACTTATGGTATCCCAGTTGTTTTACACACTGATCACTGTGCCAAAAAATTA

```
TTGCCATGGTTTGATGGTATGTTGAAAGCCGATGAAGAATTCTTTGCTAAGACCGGTACTCCATTGTTC
TCATCCCACATGTTGGATTTATCTGAAGAAACCGATGACGAAAACATTGCTACTTGTGCCAAATATTTC
GAAAGAATGGCTAAAATGGGTCAATGGTTAGAAATGGAAATTGGTATCACTGGTGGTGAAGAAGATGGT
GTCAACAACGAACACGTTGAAAAAGATGCTTTATACACTTCTCCAGAAACTGTTTTCGCTGTCTACGAA
TCTTTACACAAGATTTCTCCAAACTTTTCTATTGCTGCTGCTTTTGGTAACGTCCACGGTGTTTACAAA
CCAGGTAATGTGCAATTGAGACCAGAAATCTTGGGTGACCACCAAGTTTACGCTAAGAAACAAATTGGT
ACTGATGCTAAACACCCATTATACTTGGTTTTCCACGGTGGTTCTGGTTCTACTCAAGAAGAATTCAAC
ACTGCTATCAAGAATGGTGTTGTCAAGGTCAACTTGGACACTGATTGTCAATATGCTTACTTGACTGGT
ATCAGAGATTACGTCACCAACAAGATTGAATACTTGAAAGCACCAGTTGGTAACCCAGAAGGTGCTGAC
AAACCAAACAAGAAATACTTTGACCCAAGAGTCTGGGTTAGAGAAGGTGAAAAGACCATGTCCAAGAGA
ATTGCTGAAGCTTTGGATATTTTCCACACCAAAGGACAATTGTAA

YKL060C_homolog 359aa(SEQ ID NO 620)
MAPPAVLSKSGVIYGKDVKDLFDYAQEKGFAIPAINVTSSSTVVAALEAARDNKAPIILQTSQGGAAYF
AGKGVDNKDQAASIAGSIAAAHYIRAIAPTYGIPVVLHTDHCAKKLLPWFDGMLKADEEFFAKTGTPLF
SSHMLDLSEETDDENIATCAKYFERMAKMGQWLEMEIGITGGEEDGVNNEHVEKDALYTSPETVFAVYE
SLHKISPNFSIAAAFGNVHGVYKPGNVQLRPEILGDHQVYAKKQIGTDAKHPLYLVFHGGSGSTQEEFN
TAIKNGVVKVNLDTDCQYAYLTGIRDYVTNKIEYLKAPVGNPEGADKPNKKYFDPRVWVREGEKTMSKR
IAEALDIFHTKGQL YKL150W_homolog 906bp public: 1..906(SEQ ID NO 621)
ATGTTGACTCATCATTTATCGAAATTGGCTACTCCAAAATTCTTAGTACCATTCGCTGGTGCCACTGCT
TTGTCAATTGGTTTGGCATTGCAATATTCTACTTCCAACAATTACATTGCTAACGAAACTGGTAAAACT
TTCACTGATAGCAATGAATGGGTGGACTTGAAATTATCTAAGTCAATTGATTTGACTCATAACACCAAA
CACTTGGTTTTCAAGTTAAAAGATGAGAATGATGTTTCTGGTTTGATCACTGCTTCATGTTTGTTGACC
AAATTTGTTACACCAAAGGGTAACAATGTTATTCGTCCATATACCCCTGTCTCTGATGTTAACCAATCT
GGTGAAATTGATTTCGTGATTAAAAAATACGACGGAGGTAAAATGTCAAGTCACATTTTCGATTTGAAA
GAAGGTGAAACCTTATCATTCAAAGGACCAATTGTTAAATGGAAATGGGAACCAAATCAATTCAAGTCC
ATTGCTTTGATTGGTGGTGGTACTGGTATTACTCCATTATACCAATTGTTGCATCAAATCACTTCTAAT
CCAAAGGACAACACCAAAGTTAATTTGACTTGACTCCAGAAGATATCTTGTTAAAGAAA
GAAATCGATGCTATTGCTTCTAAACACAAGGACCAAGTTAAAGTTCATTACTTTGTTGACAAGGCAGAT
GAAAAGAAATGGGAAGGTCAAATTGGTTTCATTACTAAAGAATTCTTACAAAAAGAATTAGAAAAACCA
GGTTCTGATTTCAAGGTTTTTGTTTGTGGTCCACCAGGTTTATACAAGGCTATATCAGGTCCTAAAGTT
TCCCCAACTGATCAAGGTGAATTGACTGGTGCTTTGAAAGATTTGGGTTTCGAAAAAGAACATGTCTTT
AAATTTTAG YKL150W_homolog 301aa(SEQ ID NO 622)
MLTHHLSKLATPKFLVPFAGATALSIGLALQYSTSNNYIANETGKTFTDSNEWVDLKLSKSIDLTHNTK
HLVFKLKDENDVSGLITASCLLTKFVTPKGNNVIRPYTPVSDVNQSGEIDFVIKKYDGGKMSSHIFDLK
EGETLSFKGPIVKWKWEPNQFKSIALIGGGTGITPLYQLLHQITSNPKDNTKVNLIYGNLTPEDILLKK
EIDAIASKHKDQVKVHYFVDKADEKKWEGQIGFITKEFLQKELEKPGSDFKVFVCGPPGLYKAISGPKV
SPTDQGELTGALKDLGFEKEHVFKF YLR029C_homolog 615bp public: 1..615(SEQ ID NO 623)
ATGGGTGCCTACAAATATTTAGAAGAATTGCAAAGAAAGAAGCAATCTGATGTTATGAGATTCTTGTAT
CGTGTCAGATGTTGGGAATACAGACAAAAGAATGTCATCCACAGAGCTTCCAGACCATCTAGACCAGAC
AAGGCTAGAAGATTAGGTTACAAAGCTAAACAAGGTTTCGTTATCTACAGAATCAGAGTTAGAAGAGGT
GGTAGAAAGAGACCAGTTCCAAAGGGTGCCACTTACGGTAAACCAACCAACCAAGGGGTTAACCAATTG
AAATACCAAAAATCATTGAGATCTACTGCTGAAGAAAGAGTTGGTCGTCGTGCTTCTAACTTGAGAGTC
TTGAACTCATACTGGGTTAACCAAGATTCCACCTACAAATACTTTGAAGTTATTTTAGTCGACCCATCT
CACAAAGCTATCAGAAGAGATGCTAGATACAACTGGATCGTTAACCCAGTTCACAAACACAGAGAAGCC
AGAGGTTTGACTTCTGCTGGTAAGAAATCCAGAGGTATTAACAAGGGTCATTTGTTCAACAAAACCAAA
GCTGGTAGAAGACACACCTGGAAGAAGCACAACACCTTATCTTTATGGAGATACAGATCTTAA YLR029C_homolog 204aa(SEQ ID NO 624)
MGAYKYLEELQRKKQSDVMRFLYRVRCWEYRQKNVIHRASRPSRPDKARRLGYKAKQGFVIYRIRVRRG
GRKRPVPKGATYGKPTNQGVNQLKYQKSLRSTAEERVGRRASNLRVLNSYWVNQDSTYKYFEVILVDPS
HKAIRRDARYNWIVNPVHKHREARGLTSAGKKSRGINKGHLFNKTKAGRRHTWKKHNTLSLWRYRS
```

YNL030W_homolog 318bp public: 1..318(SEQ ID NO 625)
ATGTCAGGTACCGGTAGAGGAAAAGGTGGTAAAGGTTTAGGAAAAGGTGGTGCTAAACGTCACAGAAAA
ATTTTAAGAGATAACATTCAAGGTATTACAAAACCAGCTATCAGAAGATTGGCCAGAAGAGGTGGTGTT
AAACGTATTTCTGCTTTGATTTATGAAGAAGTCAGAGTTGTCTTGAAACAATTTTTGGAAAACGTTATC
AGAGATGCTGTTACTTACACTGAACATGCTAAAAGAAAAACCGTCACTTCATTGGATGTTGTTTACGCT
TTGAAGAGACAAGGTAGAACCTTGTATGGTTTCGGTGGTTAA YNL030W_homolog 105aa(SEQ ID NO 626)
MSGTGRGKGGKGLGKGGAKRHRKILRDNIQGITKPAIRRLARRGGVKRISALIYEEVRVVLKQFLENVI
RDAVTYTEHAKRKTVTSLDVVYALKRQGRTLYGFGG YOR285W_homolog 546bp public: 1..546(SEQ ID NO 627)
ATGTTTGCATTTAAAAAATCTACTACTTCAATTCTCAAAACAGTGGTCGCCCCAACATCATCTCGTTAT
TTATCCACCGTCACATTAAGATCAATCCCAAGAACATTCCATAATGCCACTAAAGTTTCATTATTCAAT
GGATTAAGAACTACACCAAGATTTTATAGTGTATTGACTGAATCTCCAGAGGCAAAAGTATATAAATAT
GCCGATGTTAAGGATGTGGCCGTACACCCTGAAAACCACCCTGATTCTGTTTTAGTGGATGTTAGAGAA
CCAACTGAATTTGGAGATGGTCATATACCAGGAGCTTTGAATATTCCATTTAAAAGTAGTCCCGGCGCA
TTGGATTTGTCAGAAGAAGATTTCCAAGAACATTTTGGATTTCCTAAACCAAGTACTGATAAAGAATTG
ATTTTCTATTGTCTTGGAGGTGTTAGATCTACTGCAGCTGAAGAATTGGCCAATACTTTTGGTTATAAG
AAAAGAGGAAATTATCTTGGAAGTTGGGAAGATTGGGTAAAACATGAAAATAAAAAGAACTAA YOR285W_homolog 181aa(SEQ ID NO 628)
MFAFKKSTTSILKTVVAPTSSRYLSTVTLRSIPRTFHNATKVSLFNGLRTTPRFYSVLTESPEAKVYKY
ADVKDVAVHPENHPDSVLVDVREPTEFGDGHIPGALNIPFKSSPGALDLSEEDFQEHFGFPKPSTDKEL
IFYCLGGVRSTAAEELANTFGYKKRGNYLGSWEDWVKHENKKN YOR327C_homolog 603bp public: 1..603(SEQ ID NO 629)
ATGAAGATTTATTACATTGGTATTTTAAGATCAAGTGGAGACAAGGCTTTAGAGTTAACTTCAGCCAGA
GATTTATCACAGTTTTCCTTTTTCGAAAGAAATGGGGTATCCCAATTCATGACTTTTTTCGCAGAAACC
GTATCCCAAAGAACTCAACCTGGACAGAGACAAAGTGTTGAAGAAGGTAATTATATTGGTCATACTTAT
ACCAGATCAGAAGGAATTTCTGGTATCATTATAACGGACAAAGATTACCCTGTAAGACCAGCATATACA
TTAATAAATAAAATCTTGGAAGAATATTTATCATTGCATCCTAAATCTGATTGGGAAAACATTGATAAA
GCAAATGAAACTTTACAATATGGACAATTAGAAGCATATTTGAAAAAATATCAAGATCCCACTCAAGCT
GATTCAATCATGAAAGTTCAACAAGAATTAGATGATACTAAGGTTGTTTTACACAAAACTATTGAAGGG
GTTTTACAAAGAGGAGAGAAATTAGATTCATTGGTTGACAAATCAGAAGCATTGTCAAGTTCTTCAAGA
ATGTTTTATAAACAAGCAAAGAAAACCAATTCTTGTTGTGTGATTATGTGA YOR327C_homolog 200aa(SEQ ID NO 630)
MKIYYIGILRSSGDKALELTSARDLSQFSFFERNGVSQFMTFFAETVSQRTQPGQRQSVEEGNYIGHTY
TRSEGISGIIITDKDYPVRPAYTLINKILEEYLSLHPKSDWENIDKANETLQYGQLEAYLKKYQDPTQA
DSIMKVQQELDDTKVVLHKTIEGVLQRGEKLDSLVDKSEALSSSSRMFYKQAKKTNSCCVIM YPL037C_homolog 474bp public: 1..474(SEQ ID NO 631)
ATGCCAGTCGATCCAGAAAAATTAGCTAAATTGCAAAAGTCATCTGCCAAAAAAGTTGGTGGTTCAAGA
GTTAAAGCCAAGAAGAACATCAAGACTGAACAAGATGACACCAAATTGATTGAAGCTTTGGGTAAATTG
AAAGCTACCAAAATCGAAGGTGTTGAAGAAGCCAATTTCTTCAGAGAAGATGGTAAAGTTTTACATTTC
AACAGAGTTGGTGTTCAAGGTGCTCCAGCTTCTAATACTTTTGCCTTCACTGGTTACCCACAAGAAAAG
AATATTACTCAATTGATCCCACAAATTTTACCACAATTGGGTGCTGAAAACTTGGAAATCTTGAGACAA
TTGGCTGAACAAATCCAAGCTGGTAAAACTCCAAAAGACTTCAACACTGGTTCTGCTAACGCTGCTGCT
GATGCCGGTGGTGAAGATATTCCAGACTTGGTTGACCAAAAATTTGACGATGTAGAATAA YPL037C_homolog 157aa(SEQ ID NO 632)
MPVDPEKLAKLQKSSAKKVGGSRVKAKKNIKTEQDDTKLIEALGKLKATKIEGVEEANFFREDGKVLHF
NRVGVQGAPASNTFAFTGYPQEKNITQLIPQILPQLGAENLEILRQLAEQIQAGKTPKDFNTGSANAAA
DAGGEDIPDLVDQKFDDVE YPL079W_homolog 330bp public: 1..330(SEQ ID NO 633)
ATGCCACACAAATACTACCACGGTAAGACTGGTATTGTTTACAACGTTACCAAATCCTCCGTTGGTGTT
ATCATTAACAAAGTTGTTGGAAACAGATACATTGAAAAGAGAGTTAACTTGAGAGTTGAACATGTTAAA
CACTCTGCTTGTCGTCAAGAATTCTTGAACAGAGTTAAATCTAACGCTGCTAAAAAGAGAGAAGCTAAA
GCTAACGGTGAAACCGTTTACTTGAAGAGACAAGCTGCCAAGCCAAGAGGTTCAAGAATTATCTCCACT
GAAGGTAACATTCCTCAAACTTTGGCTCCAGTCGCTTACGAAACTTTCATTTAA YPL079W_homolog 109aa(SEQ ID NO 634)
MPHKYYHGKTGIVYNVTKSSVGVIINKVVGNRYIEKRVNLRVEHVKHSACRQEFLNRVKSNAAKKREAK
ANGETVYLKRQAAKPRGSRIISTEGNIPQTLAPVAYETFI YBR089C-A_homolog EMBL_entry 279bp public: 1..279 (SEQ ID NO 635)
ATGGCTCCAGGTGAAAGAAAGAAGTCCTCTAGAAAGAAGAAGGATCCAGATGCTCCAAAAAGATCCTTA
TCTGCTTATATGTTTTTCGCTAATGAAAACAGAGATATTGTTAGAGCTGAAAACCCAGGTATCTCTTTT
GGTCAAGTTGGTAAATTATTAGGTGAAAAATGGAAGGCTTTAAACAGTGAAGATAAATTACCTTACGAA
AACAAGGCTGAAGCTGATAAAAAGAGATATGAAAAAGAAAAGGCTGAATACGCTAAAAAGAATTCCGCC
TAA YBR089CA_homolog SWISS-PROT_entry 92aa (SEQ ID NO 636)
MAPGERKKSSRKKKDPDAPKRSLSAYMFFANENRDIVRAENPGISFGQVGKLLGEKWKALNSEDKLPYE
NKAEADKKRYEKEKAEYAKKNSA YBL092W_homolog EMBL_entry 396bp public: 1..396(SEQ ID NO 637)
ATGGCTACTTCTGTTCCACACCCAAAAATTGTTAAGAAATACACCAAGAAATTCAAGAGACACCATTCT
GACAGATATCACAGAGTCGCTGAAAACTGGAGAAAACAAAAAGGTATTGATTCATGTGTTAGAAGAAGA
TTCAGAGGTACCATCCCACAACCAAACATTGGTTACGGTTCCAACAAAAAGACCAAGTTCTTGAACCCA
GCTGGTTACAAAGTTTACTTGGTTAAAAACGTTAAAGACTTAGATGTCTTGTTATTGCACACTAAATCT
TATGCTGCTGAAATTGCCTCTTCTGTCTCATCTAGAAAAAGAGTTGAAATCGTTGCTAAAGCTAAGAAA
CTCGGTGTTAAAGTCACTAATCCAAAGGGTAAATTGAACTTGGAAGCTTAA YBL092W_homolog SWISS-PROT_entry 131aa (SEQ ID NO 638)
MATSVPHPKIVKKYTKKFKRHHSDRYHRVAENWRKQKGIDSCVRRRFRGTIPQPNIGYGSNKKTKFLNP
AGYKVYLVKNVKDLDVLLLHTKSYAAEIASSVSSRKRVEIVAKAKKLGVKVTNPKGKLNLEA YDL059C_homolog 2791bp PathoSeq: 1..2791(SEQ ID NO 639)
TATCCATTGGTAATGAATCAGTTAATACCACTACCAAAACTGTTTTATTAAAATCTAGAGCAGATTTTAATACTG
TGATTATTGAATTTGTTGATAACAGAGTCGTGGAATTGGATTCTACCCTTGATTGTAAAGAAATTGTCAAATTCC
CTCAATTATGTCGTGATATTGAAGTTTCTTTTAAAGAAGATACTCAACAATATGAAGCTTTTGGGATTTCTCGAA
ATGGGAAATTATTTTGTAATGAAAACCATGTTGTTAGTGGTGTCACATCATTAAAAATTACTGAATCTCATTTAT
TATTCACTACCGTACAATCAAAATTATGTTTTATTCATTTAAATTCAAGTCAAGAAAATTATGAAATTTTCTGA
ATTTAACCAATGAAAATATTGTTGATGAAAGAATTAGACAAGTGGAAAGAGGATCTATATTAATCAATGTAATGC
CAACGAAATATTCTGTAGTTTTGGAAGCCCCTAGAGGTAAATTTGGAAACTATATGTCCAAGAATAATGGTATTAT
CAGCCATTAGAAAATTCATTAAACAAAAAATTATAAAGATGCATTCATTACTTGTCGTACACATAGAATTGATT
TAGATATTTTACATGATTATGAACCGGAATTATTTTTCAATAATGTGGAAACATTTATTAATCAAATATCTAAAG
TGGAATACTTGGATTTATTTGTTTCTTGTTTACATGAAGAAGATGCAACCGTTACTAAATATAGAGAAACAATAA
ATGATGCTGCTGCTGCTGGTGGTGGTATTACCAAAGAAGAAGAAATCAAACGTGAAGGTGAAACTCTTCAAC
CAGCATTCAGGAAGAAATTCCATCACATAAAGGAAAAAGTTTTCACCAATTTCAATGATTCCAAAGTTAATCGAA
TTTGTGAAGCCATATTAAATGTATTATTAAAACCAGAATATTTTGATAAATATTTACAAACGATTCTTACTGCTT
ATGCTTGTGAGAAACCAGCAAATTTGACTCAAGCACTCACATTAATTGGTAAAATGGATAATCAAGAACAAAGAG
AAACTGCAGTGACTCATTTATGTTTCTTACAAGATGTAAATAAATTATATAAAACATGTTTGGGACTATATGATG
TCAAATTAACTTTAGTCATTGCTCAACAATCACAAATGGATCCTAAAGAATATTTACCATTTTTACAAAATTTGC
ATGTACAACCAGAATTGAAAAGAAAATTTTTAATCGATGATTATTTGAAAAATTATGAATTAGCTTTGAAATGGT
TACATGAACAAGGTGATGAAGCTCATGAAGAATTTGATGATTATGTTGTATTACATGAATTATACAAACCAGCTT
TGAAAATTTATACCTATGATAAACCCAGAACAAATGTAATCATGGGATTGTTTGCTGAACATTTACGTGAAACTA
AACAATTTGGTGAAGCTGGTGTGATATTTGAATATTTGATTGATTTGGAAAATGCATTAGAATGTTATATAATGG
CCAAGAAATGGAAACAAGCATTATCATTAGTTGAGAAAAGTGCTGACCTTTTGGAGAAATTATCTGATACGGCTG
AAAAATTAGTTGAAACATTAACTGAAGATCATAAATATAGTGATGCTGCTGAAATTGAATATCAATTTTTGGGGA
ATGTTGAAGCATCTATCAAATTATATTGTAAACAATATTGGTATGATCATGCTATATTATTAGCTGAAAAATCTA
AAAAACCAGAATTGATTGAATCAATAGTTGATGTTCAAATAAATGAAGGGTTTGGGGTGATTGCTGAATTATTAG
CCGATTGTAAAGGGCAAATGAATTCACAATTGAAAAGACTTCGAGAATTAAGAACTAAAAAGCAAGAAGATCCAT
TTTCGTTTTATGGAACTCCTGATGATTTAGATACTCCTGATAATGTATCGGTTGCTGCTTCTGAAACATCAACCA
CCCCATCATTTTTCACAAGATATACTGGTAAAACTGCTGGTACGGCCAAAACAGGAGCATCTAGAAGAACTGCCA
AAAACAAAAGAGAGAAGAAAGAAAACGTGCCAAGGGAAGAAAAGGTACTATTTATGAAGAAGAGTATCTTATTA
AATCAGTTGGTCGTTTATTAGAAAGATTAGATCAAACCCAATCAGATGCGCTTAAATTAATTGAAGGACTTTTAA
GAAGACATATGAAAGAACAAGCTTATCAAATACAAAAGAATTGGTGTGAATTGATTGATTTTATCAAAGAAATA
TCGATGAAATTCATAATATGAGTGAAAAAGATCGTGAAAGAATCGATGATAATGGTGAAATCTATTTGATTGATG
AAATTCCAAAACCTAAAGTATCAGAATTCCCTAAATTCAATATATTAGATTATTAATCATGGAAATAAGCTAAGA
TAACTTTTATTTATAAATAGAACCACAGAATCATCTTACTCCTTGTATAGACTATATTTATTTATTTATTTATTT

```
ATTTATATATCATATTCAGGAGCAAATTGTTTCATCAATTGTTCTTGTTCATATTCAAGATAAAGATCACGTAAC
CCCACAATGGCATTTTTTATAGCATCAGTAACTGCTTTCTTTCGAGCACTAGCATAACACATATGTTTATAAGGC
ATATTTGTAGATTCTGCTTGTCCCAGTTGTTCTCTAAAAGTACCATCTTTCAATATTAATCGTATTTTCACTACA
ACAAGGGCAGAATACTTGTTTTCATCTTTTATTTTCCCGTTTGGGTTAAAATTACCAATCCCAAAAATTGTCGGG
GTGACCATTCCATCCA

YDL059C_homolog_1 67aa PathoSeq: 1..67(SEQ ID NO 640)
ENKYSALVVVKIRLILKDGTFREQSGQAESTNMPYKHMCYASARKKAVTDAIKNAIVGLRDLYLEYE YDR377W_homolog 24076bp PathoSeq: 1..24076(SEQ ID NO 641)
ACACTACTACTGGTCGTTGGTCGTTTTCTGGCAATGCCCCGGAAAAACCTTAAAACTGTTATTTGGTCCATTGCC
GTCAAGCAACCAAAAATAACAATGGCGGTCCCGGAAGATGCAGCGTACCAAGAAAAGAGGGGATAACCGATGTGT
TTGTCACCACTAAGCCATCTAGCAAGTCTATGAGCTCAAATCAACACAGAAGAGAAAATCAAATCCACACATGCT
TGGTAGCACTAGGCGAATTAGAGTTTTCAGTTTTCATTCTTATTGTTAAGTGTTGATTGAGCAACATAAAAAGCC
TTGTCCACTTTCTCGAGGCAGTTACCGGAATATTACGTATTCTCCTCCTTCTCCCCTATTTTCTAAACCAACAAA
CAAAAAATAAATATCATGAGAAGTTAAAGAAAATAAATCGCTCAAAGTTTATCTACGCAAAACTATGCTAAAACA
ACAAACCACAAAAAAAAAAAAAAGAAATTGTCGACAGCCGTAATAGAGTCTAGACCATCTGCTCATTACCCGAAT
GAGCTGGTCAGTATCTTTCAAAATTATTGGTTAACCAACAATACCGTCAACTCAAGTCCTAACCTCTTCTTGCCA
ACCCCTCTAGCACCCCAAGGAACAATCGAATGTTTCTTCCTTCTCTCTTGAAACATTCTTAATAATACGTATGTA
ATTATTTGCTGACTTCTTTTTTTTTTGTTTTTTTCTTATTTTTAGAACTTCCGTTTCCCCGCTCCTACTAAAAT
CTTCCCGGGTTGAACGGTAAGTCTCGGAATACACTTCCTAATAATTCCTATACACCAATTCTACCCCAGATTTTT
TGGAGGTTGCGCGTAACCTATTCATATGCCCCCGGGACAAGGGAAGCAATCTTAAAAAGAAAAAAAATTTTCCAG
CAAAATTCGTTGATACAAGTCTTTATTAATGGTCTGATAAATTAGTATAAAACCACCATCAAATTCCCTTGAAAA
CTTGATTGATTTTTTTCTTTCTTTCTTCGAATCAATCATTAACTTATTCAAATAATTATCAATCATGGCTCCTCC
TACTGCTGTTGAATCTTCAATCAATTTCGGAGGTCACCCAACTATCAAATCCACTCAAGACCCATTGGTCCAAAA
GTTGTCTCTTAATACCGACACTGTGATCAGACACAATGCTCCACCTCCAACCTTATACGAAGATGGTTTATTAGA
AAAAGGTACTACTATCTCATCTACTGGTGCTTTAATGGCTTACTCTGGTAACAAAACCGGTAGATCTCCTAAAGA
CAAGAGAATTGTCGACGAATCCACCTCATCCCATAACATTTGGTGGGGTCCAGTGAATAAACAAGTTGACGAATT
AACTTGGAAGATTTCTAGATCAAGAGCTTTGGATTACTTGAGAACTAGAGAAAAGTTGTTTGTTGTTGACGCTTA
TGCTGGTTGGGATCCAAGATACAGAATCAAGGTCAGAATTATCTGTGCTAGAGCTTACCATGCTTTGTTCATGAC
CAATATGTTGATCAGACCAACTGAAGAAGAATTAAAAACTTTGGTGAACCAGATTTCACCATCTACAATGCTGG
TCAATTCCCAGCCAACATCCACACTAAAGGTATGACTTCTGCCACTTCTGTTGAAATCAACTTTAAAGATATGGA
AATGGTTATCTTGGGTACTGAATATGCTGGTGAAATGAAGAAAGGTATCTTTACTGTTATGTTCTACTTGATGCC
AATCAAACACAAGGTTTTGACTTTGCACTCCTCATGTAACCAAGGGGTTGAAAAAGGTGATGTCACTTTGTTCTT
TGGTCTTTCTGGTACTGGTAAGACCACTTTGTCTGCTGATCCACAAAGAAAGTTGATTGGTGATGACGAACATTG
TTGGTCCGACAATGGTGTGTTCAACATTGAAGGTGGTTGTTACGCCAAATGTTTGGACTTGTCTGCTGAAAAAGA
ACCAGAAATTTTCAACTCCATCAAGTTTGGTGCTATTTTGGAAAATGTTGTCTACGACCCAATCACCAAGGTTGT
TGACTACGAAGATTCATCAATCACTGAAAACACTAGATGTGCATACCCAATTGATTTCATTCCATCTGCCAAGAT
TCCATGTTTGGCCGACACCCATCCAACCAATATTATCTTGTTAACATGTGATGCTTCCGGTGTGTTGCCACCAGT
CTCCAAATTGACTAATGCTCAAGTTATGTATCATTTCATTTCTGGTTACACCTCCAAGATGGCAGGTACTGAAGA
AGGTGTTACTGAACCACAAGCTACATTCTCCGCATGTTTCGGTCAACCATTCTTGGTGTTGCACCCAATGAAATA
TGCTCAACAATTGTCTGACAAGATTTCCGAACACAATGCCAACGCTTGGTTGTTGAACACTGGTTGGGTTGGTTC
TTCTGTTGCTCAAGGTGGTAAGAGATGTCCATTGAAATACACCAGAGCTATCTTGGATGCTATCCACTCTGGTGA
ATTGTCTAAAGTCGAATACGAAAAGTTCCAGTTTTCAACCTTAATGTTCCAACTTCTTGTCCTGGTGTTCCAAG
TGAAATTTTGAACCCAACTAAAGCTTGGACCCAAGGTACTGATTCATTCAACAAGGAAATCAAATCTCTTGCTAC
CAAGTTTGCTGAAAACTTCAAGACATACGCTGATCAAGCTACTGCTGAAGTTAAAGCTGCTGGTCCAGAAGCATA
AACAAACAAATAAACAAAAAAAAAAAAGATCAAGACATGTCAGTTATGTTTTTTATATAGTTCCATACATTTCAT
ATTCATATATATATTTATTTTTCAATGGTTTTTTCAAAAAAAAAGTTGAGAGTTTTGAATGTAGAAGTGTCAACC
TGTGGTGCACATACGAAAAAACACCCAGAATAACTCTATAGTTAGCGCCTCATGATTAAAAAAGGGGACA
ATCAAAGCCACAACGTGTCAATCTAGACATTATCTCTATTACCATACTCATAACTCAAAATCTCAATTTCCCATG
TGCATAGCCATTTAATTACGAGTTTAGAGATAACAAACTTTCACAGGGGCTTGGTGATGTTATGTTCTATTGTTT
GGAGCGGATATTCCTGTAGCAAAACAATGAAGAGTCTAATTGCATAACCTTAATTGGATGCATTGATTCAGAGAA
GAATGATAAGGCACTGTTTCATTGATAAGATTAGGTCTCATAATCCTATGGGGCGTTGAGCTTGTGATAATTTTT
CCTTTTTTGACAGAAAATTAAGTTGGTTATGAGTTGGTACTACCTGGCCTGTGATATTCACTTAATAGCAGCATA
CAAGCATTGTCAACGACATAGTACTGTGTATGACAGAACATTTTGTGTGACTAGAGCTTGCAGAATGTAGAGATG
GATGGATGCTGCAAAGAGCGGCTGCGGATAGTAAGCAATAGTTGTGTTCAGATATTTTATTTGCAGTTGTTATCT
CCGCCAAGTGATGATATAATTTCCACTAACCGCAATACAAAGAACGGAGAAAAGACAAAAAAAGTACACAAAAGC
TTAACCAGGCGATGGAAAAAATTAAAATCTTTACAATTTTTTTTTCCTTAATTGTTTGAAAAACTCCGCATTTGC
ACATGCACTACTGAACTAGACATTTGGATTATTATTTATAACCAATGTAATATCCCACCTTCCATCAATATGAAA
AGTTGCAATATCAAATTCAAATTCAGAATAGCAATCCATATTTATTTATTATCATGAGTGTTTCAGACATTGTCC
```

```
AAGAATATATCACCAAATGGTATGTCGTTATACCTACTTTGTTTGTTGTCTATCAGGTTGTTGATTTCTTCTATG
TTAGAAGCTTAAGAAGTCGTCTTGGTGCCAAAGCTCCTACAAACAACGAATCCGATGGTTATTGGGGGTTCCATT
TACCATTCTTGTTGGTTTCCAAAAAAGCTGAAGGTACAATTATTGATTTCGCTGGTGAACGTTTCAAAAGTATTG
CCCACCCAGAAGTCCCAACTTTTCAGTTCCCAATTTTCACTGTCAAAGTTATTTCCACCGTTGATCCAGAAAACA
TTAAAGCTGTATTGGCCACCCAGTTCAATGACTTTTCATTAGGTACTAGACACAATCAATTTGCTCCATTGTTGG
GTGATGGTATTTTCACATTAGACGGTGCTGGTTGGAAACATAGTAGATCTATGTTGAGACCACAATTTGCCAGAG
AACAAGTTGCTCACGTCAAGGCATTAGAGCCTCACATGCAAGTATTATTCAAACATATCAGAAAGAGTGGTGGTA
GAACTTTTGATCTCCAAGAATTGTTTTTCAGATTTACTGTTGATTCTGCTACTGAGTTTTTATTTGGTGAATCCG
TCGAGTCTTTGAGAGACGAAAGTATTGGTATGGCTTTAGAAGCAGTCGATTTTGATGGAAAAAAGGAATTTGCTG
AAGCCTTCAACTTTTCTCAAAACTATTTGGCCTCCCGTGCTGTTATGCAACAAATGTACTGGTTATTGAACAGCA
GTGAGTTCAAAAGTTGTAACTCCAAGGTCCACAAATTTGCTGAATACTATGTCAACAAGGCATTGGAGTTGTCTC
ATGAAGAATTGGAAAAGCAACAAGGTTATGTCTTTTTGTATGAATTGGCAAAACAAACTAGAGACACCAAAGTGT
TGAGAGACCAATTGTTGAACATTTTGGTTGCTGGTAGAGATACCACTGCTGGATTATTGTCGTTTGTGTTTTTCG
AATTAGCTAGAAATCCAAGAGTGTTTGCCAAATTGAGAGAAGAGGTTGAAGAAAAGTTTGGTGTTGGTGAAGATG
CTCGTGTTGAAGAAATTAGTTTTGAATCATTGAAACTGTGTGAGTACTTGAAGGCTGTTCTTAATGAATGTTTAA
GATTGTACCCATCGGTCCCACAAAACTTTAGAGTTGCTACAAAGAATACTACCTTGCCAAGAGGTGGTGGTTCTG
ATGGTATGTCTCCAATTTTGGTCAGAAAAGGTCAAACTGTTATGTACAGTGTTTACGTTACCCACAGAGACACTA
AGGTTTACGGTAAGGATGCTGACGAATTCAGACCAGAGAGATGGTTTGAACCAGAAACCAGAAAATTGGGTTGGT
CGTTTGTTCCATTCAACGGTGGTCCAAGAATCTGTTTGGGTCAACAATTCGCCTTAACTGAAGCTTCTTATGTTA
CTGTCAGATTACTTCAAGAATTTGGTCATTTGACTATGGACCCAAATACTGATTATCCACCAAAAAAGATGTCAC
ATTTGACCATGTCTCTTTACGATGGTACTAATGTTGAAATGTATTAAGCAGGGCTAGATTTATATAGGGTATATA
GGTATTTTAAGAAGGATAATTGTTTGCAAAAAAGTGCTGTAGATTTTCACATGACTGAGGGTCTTTGTGTTGTA
TGTAGAACAAAACCTATATGCAGAACAATAGGGATTGCCATTTCCTTGTTTTTGATTTGACAACTTTGTATGCGC
CCTTTTGTTGTTGGGCATACATATATATTTTGCGACTAGCATGTGATAGACCAGCAGAATACACTACTATCGAAT
CAGTTAAAGTAGATCTAGAAATAAACTCAATGATAATCGTGGCACTATTATTAGAGTTTAACTTTTTGCGGAAAT
TCTAAGTTCTACCAAGAAATCCTTTGACTGATCTTGATGCTCCAATTTATTTTTTTTAATTATAGCATCGTCTC
GTATTCCCAAGCTTCTAGTGTATTATTTTGATTATATCGACAAACTGACAATGCATAGAGGTGCATGTGAACCAG
CTCTATTGTCTGGCTAACTTCTTGGTGTGGGACATGATGTAATCGAGAATTTCAGATTACACACAGAGAGGGTAAAT
TTAGCTTTGTTTTAGGATCGTCGCAATTGATGGAGAACAATAACCATTACAACTCCGCAACACTCCGAGAAGTAT
ACCAGTATTCGTTATTCATCAGGAGTACATGTGAAAAAGAAGGGAGGCACTAAAATTATGAACATTTCCATTGTT
CAGCATAAAAGGAACGTTCGTGTACTTGTGCAAAAGAAAGCACCAAACCTCCTTACTATTCGTAACACATTTTCT
ATATTGAGGGGTTATTGTAATGATACTTTGACAATCACTTTAAACAGCAAAACAATTGCCATGTGAAGAAGAGT
ACAAATATATATATGTTTGATAGGATCCTGCTAGCTACAATGTTTCATTTTTACAGAATAACCAAACAAAATGTC
CCCCTCGCTTGTTCACCAAATTCTTGCTATCACTCATCCATATGTTGAATATTTGGAAGAAAACATTACTAAATG
GTATATCCTAGTACCAGGTATTCTTATTGTGTTAAATGTGTTAACAACTCTTCATACAAAGTATTTGGAATACAA
ATTTAATGCAAAGCCTGTCACAAACTTCATTCAGGATTACACTTTTGGTGTCATAACTCCATTGATTTTGATCTA
CTACAAGTCTCAAGGTACAGTAATGGAATTCGCCAATAATTTTTGGAACTTCAAATTTCTCATCAAAAACCCAGA
TGTAGGAACAGGTGAGCTTAGAATATTTGGTATGCATTTAATTGAAACCAAGGACCCGGAGAATATCAAGGCGGT
ATTGGCTACCCAATTTAACGATTTCTCTTTGGGCACTCGTCATGGCTTTTTGTACTCATTGTTAGGTGATGGTAT
TTTTACATTGGACGGTGCTGGCTGGAAACATAGTAGATCTATGTTGAGACCACAATTTGCTAGAGAACAAATCGC
TCATGTCAAAATCTTGGAACCACATATGCAAGTGTTTTTCAAACACATTAGAAAGAACAAGGGGAAAACATTTGA
CATCCAGGAGTTATTTTTTAGATTGACAGTTGATTCTTCTACAGAATTTTGTTTGGTAGTTCAGTTGAGTCTTT
GAGAGATGAAACCATCGGCATGTCACCTAGTGTGAAGAATCTTGCTGGCCGAGATGAATTTGCTGATGCATTTAA
TTATTCACAAACTATCAATGCCTACAGATTCTTGTTGCAACAATTTTATTGGTTGTGCAATGGGACTAAGTTTAG
AAAGTCAATTGCTGCTGTGCACAAGTTTTCTGATTTTTATGTTCAAAAGGCTTTGAGTTTAAGCCAAGATGAATT
AGATGAACAAAAAGGGTATGTTTCTTGTATGATGAGTTAGCCAAACAAACCCGTGATCCAAAAGTGTTAAGAGATCA
GTTATTGAACATTTTAGTGGCTGGAAGAGACACAACTGCTGGTTTGTTGTCATTTGTGTTTTTTGAATTGGCCAG
AAACCCAGAAGTATATGCCAAGTTGAAAGAAGAAATCTACAATAAGTTCGGGTCCGGCGAGGATGCTCGTATTGA
TGAAATCACATTTGAGTCTTTAAAACAATGTGAATACTTGAAAGCTGTTATCAACGAGAGTTTGAGATTGTACCC
ATCAGTGCCACACAATTTTAGAACTGCTACTAGAAATACCACTTTACCAAGAGGTGGTGGTCCAGACGGTATGTC
ACCTATAGTTGTTAAAAAGGGTCAATCAGTTATGTACACAGTTTTGGTAACACACAGAGATACCAAAACTTATGG
AGTGACGCTAACGAATTTAGACCAGAAGATGGTTTGAACCAGAAACTAGAAAATTGGGATGGGCTTATGTCCCA
TTCAACGGTGGTCCAAGAATTTGTTTAGGTCAACAGTTTGCTTTGACTGAAGCTTCTTACGTTACTGTTAGATTA
CTTCAAGAGTTTGAGCATTTGACTATGGATGCAGAAACTCGCTACCCTCCTAAATTAATGAATAGTTTGACTCTT
TCCCTCTTAGATGGGGCAAATGTTGAAATGTATTAAGCGCAAGTAGTTTATGTATGTATAAAACATTCGAAATAA
AAAAAAATGTCGCCTTTTACTTGAGTCGCTCGATTGTGCGAAGCAAAAAAAAAAGAAAAATTTGTAAACATTTTT
CTTTCAACTCATCCGTCATTCTTTATTTACATCCCACTCAACCAACGACAACGAACAAGAATGAGTGGCATATTT
AATTGGTCGCTGGATGTGTTTGCCCGATATTTATAACACCCTCAAGTTTGAGTCCAATATAGATTTGGATACAATC
GACTTCACCAGCATCAAGAATGATCTTGCAAATGTTTTGATTACACCAGTCCCTCTGGATCAATCACGTAGCAAA
CTTGGAGACGCATCAAAACCAGTGGCGTTGCCCAGTGGAGATGAGGTGAAATTGAATCAAGCATCAATTGAAATT
```

```
ACTGGAGTTTTATCAAATGAATTGGATTTAGATGAACTAAATACAGCAGAGTTGTTATATAACGCAAGTGACTTG
AGCTACAAGAAGGGAACGTCCATTGGCGATAGTGCTCGATTGGCTTATTATTTAAGAGCTCATTATATACTAAAC
ATTGTTGGATACTTAGTTTCGCATAAACGTTTAGATATCATCACTAACAACAACCAAGTGTTGTTTGACAATATT
TTGAAAAGTTTCAGCAAGATTTATACTTTGAGTGGTAAATTAAATGACATGATTGACAAGCAAAAAGTTACCGGC
GACATCAACAATCTTGCATTTATCAATTGTATCAATTATTCCAGAAGTCAGTTGTTTAATGCACACGAGTTATTG
GGACAAGTTGTATTTGGATTAGCGGATAATTATTATGAGAGTTATGGCACACTAAACAACTATAAATCCTTAGTG
GAGTTTATACTGAAAAATATCAGCGATGAAGATGTTTTTGTTATCCATTTTTTACCATCCACTTTACAATTGTTC
AAGAAATTACTTCAACTAGGTGAGGAATCTTTAGTCGATCAGTTTTACAAGACTATAACCTCTTCCATACTAAAA
GATTATGAAGCCAACAATTTTTCCAAAAGTGAAGATATTGACTTGTCAAAATCAAAATTGTCTGGCTTTGAAATA
GTCACAAGCTTTATTTTTCTAACTGAGTTTATTCCATGGTGCAAGCAGCTGTCAAGTAGAACCGCGAAATACGAT
TTCAAAGATGATATATTAAAGTATATGGAATTCTTGATAAGTTATGGAGTTATGGAACGATTATTATCGTACTGT
TCTGAAACCGCCAATGCAAAAACTCAGCAAGTGTACGACTGGTCAAACATGTACGATTTCAGAGCATTGCTTCAA
AAGAATTTCCCACGACTTACACCAGCAAAATTTCATTATCCTGGCAATCAAGAATTGTTGAATGCAGTTAGACCG
GGATATGAAAATGTATCCAAATTGATTGACATTTCCTTTTTGACGTTAGATCCATCGCTTAATGAGACGTTGGTT
TCACCTTTTTTCCAGAGCTTTTTCAGTGTGTTTATATCTAATGCGGCAGTTGTTTATGACCTCTTTAAGGGACTCA
GAGGAAGATTTTGTTTTATCGTCGTTGAATGAAAGTGACGAAGAGGAAGAAGAAGAAGAAAGCGACAGCGACGAA
GATTCTTCGACCCCAAAAAACAAAGAAAAATCAACTGGGTTAGACCTTGACAAGATTGCCCAGCGCGCTGAATTA
GAAAGGTTCTACTTGGCTTTCGCGTACACCTACAACAATAGACCTGAATTGTGTGCGTTATTTTGGGGGAACGAG
CAGGTAACTCATGACATTATAGGATTTATTTCCTGGGGACTTGCTAATAATACGTCTCCGTTGATCACTGCAACA
TTCTGCTTACTATTAGGGTCGTTGGCATCTGCTGGTGCAGAGGCAACTTCAAGGATATGGGAGATTCTTGTACAC
AACAATAACAACGCAAGTACGAGAAAAAATGATTTTTCAAAGATATCCGTTGACTCCCTTTATGATTCGTTGAAA
TATTACATTGACTCTTTAAATGAAAGCTTTGAACAAGATTTAAATGCCCAATTGATGTTGAATCAGAAGAAACAA
GATTTTCTCTTCAGCACCACAACAAGCAAACAGGACCTTGATGATTCTGGCGAGAATAGAATTGTTATAGAGTTG
GCCGAGGATTCACTTGTCTTCATTTCAGGGTTTATTCAATTACTTTCTGCAATTGTGAAGAATTTGAACACTAAG
AATGAAAGAAGCAAAGAAATCAAATCCGTGGTATACACTAGATTCTCACCAATCATTAAAGGGTTTTTAAAATTC
GATAATTTGATCAATGGTAGCAGGTTCCTTCAAGTTGATGCTAGCATTCAAAGCACAAACAACCCCAAATTTATT
GATTTGCCAAATGTTTTCGTCAGTGATGACTCGAGAATTATATTGACGAACCTCATTCTAACCTTTTTAGGCGAT
TTTGTTACCAACGATAGTGATCCGTATATTAGATATGAGATTTGGCGTTTAGTCGATCGATGGATGTACCAGGGG
TTGCATAGTTTGCCAGAAGATAAGAAAGATGATGCTTTTAGACATATTAAGAGAAAGTATATCAGTAAGAAAAAT
GTCCCCATCAATCAAGCATTTTCAACAAACCTAACTCATCTTAGTCAGATTGGGAATTTCACTGTCTTGGTGAAA
AAATTGTTAACCCCATACGCAGATAGTAATGAAGCATTCACCAAGTACTCGTTGTTGTATCCTTGTGATTTAGGA
TCAGGGTATAGATTCAACAACCAACTTGGAATTTGGCCATACATTGAATTTTTAATGCAAAATGTGTTTGCAAAC
TCTGCTACTATTGCTAATAAACGAGATAGGGTCAATTCTTAATTTGCTAGAATTATTTAGCAATGCATTA
CAGGAAGTTGACTGGAAGTTTCTTATTGATGTGGCACCGAAAATTATTCGTGACTTGAAAAATTTTAATGGGATA
TTTGACTCGCTTATTCCTGGTGTTCAATTGGACTTTGAAGTGTTTGTCAAATTGCATCATTCAGTTGCTGTGATT
AACTATCTATTTGAAAACAAGACATTTTCTGCTTTGTTTAAGCTTGTTAATATTGGAGTTGATTCTGTGAATGAA
TCAGGTGAATCGGCTGCATTAGTGTCACATGCCCTTGGGTTGATTAATTCTTTGTTGAGAGTTCAAAATTCTTTT
ATAAACAAGTTGTTACCAATATTGCGAAACAAAGATACGCAGCAACAATTACATTGTGGGACAGCCATTGGGATT
GGTACTTCTATGAGTCTTTCGTTAGCAACCCCTAGAACCATATTTGATTGTATATACTATCCAAAGAACTTGGGA
ACACATGGTGTTGCTGATTTCTACGAAGTGATATTGTTCCACTTATCTGCAGTTGTCCAATTTGCCCTTTATGTC
AGTTGTGAAAATACTATTTCCAACAAAGCAATTTCCATATTGAAAGGAGTAAGCCAATCGAAATTTTTTGTTACC
AGAGTTTCAAGCTCTGCTGATCCCTTACTCAACAACGATAGATTGATTACCACATTTGAAAACATCGACGAGTCA
ATAAAAATCAAGTTTGCTTTCATTGACAAGTTTGAAGAACTCGAGGACTCTTTGAATATGAAATATGAGATATTG
GATTTTGTTTTGGGCAATCTCAATCAATTTGATGGCAAAGTGGCTACTACTGCCCACTTTTTGTTGGGATACAAA
GTGAAAGGCGATACATTAGACTTGGTACAGACAAACGATCAAAACACATTACTAAAATCTTTCTTAAATACATTG
AGCATTAGTCTTGATTTAATTTCTGAAATTGATTACAATAATGGTAATAACCATATTATTGATGTTGGTCCAGCC
AAGCTTTCGTCGTTGATTTTACAGATTCTTATCAAGTTGTGCCAAGATCCAATTTCGTCGTCAATAACATTGAAT
CAATTACGTGAATATGAAGAATTGTTTGAAAAATTGGTTAACTGTCAACCTAAACTTGATTTGAATACCGTTTGG
TGTGGTAACCAGTTTGATGGGGATTTGCAGATTGATGCTAGCAATGTATTTGTTGACAACCAAGCAAGCACCCAG
GCTTTCTTTTCCTTTATTAACCAGAGAAACTTAATTTTGCAGTATTTGTCATTGGAATTCCATAGTGTCAAATCA
AGAACTAAGCGGGAGTATTATTCTAAAGTGTTGACCAACGACAAGGAATTTGTTAATCGTACACCTAAGGTGTTG
ACATTTTTAAACATTCTAAATTATTCATTCAAGAACTTTGAAGTGCAGAAATACGAATGGCTTGACCAAAAATTT
AACATGTCGTTGTTATTGGCAGAAGTAAACGCTCAAAAGAATGGTACATTAGATTTTCTGTTTTAACAAAGGTT
TTCCGTCTTTTGTGCCAAACGTCAAACTTAATAACACCCGAGTCAAAGCAATTGTTTGCCGAAGAAATTATGGTT
GAAGGAAGTAAGATTTCTGACTTTGTCACAAAGTACCTGGTGTCGACCGACTTGAAGGATGTGCAGTTGAAATGC
TTACATTCATGGTGTCAATTGATAGAGATTTTGGTTACTGACAGTGGAATCAATTCGCTGAATTTCATCTTGGAA
GTGTTGCAAGTTATTATTCCCAAAATCAATGACTATTTTGATGTGGACATACTGTTTTCTGAAGAAATGGTTTCA
TTATGTGTTTTATTGTTTGATCTTTATGATCAGCTGACTCTTGCGGACAGAAAAGGTGAAGATTTTGCACTTGGA
ATTGAGAGATTGATCCCCTTATTTCAGACTTGTATTGCAGGTATTCTTAATTCTAACTCAACACCCAGCTTACGC
TCAGACTTGTATGTAGTTGGCAACAAGTTTTTGTTAAAATGTTTTGAGAGAGAGTCGTTTTTGAAACAAGTGATG
```

```
CATATCATCAAGTCGGTAGATAAAAAGTTTTTCCAGGTGATTTGTAATGACGCTATCTACTCAGAGGGTCCATCT
AGAATCACTTCTACTTTATTCCTCGAGTCATTAGTTCACTTAGGGACTTTGGTCAAGGTTGATTTTATTTTGAAT
GCGTTGATCAAAAATAACGCATTGCTGTTGCTAGTCAGGTCAGTTAAGCGGACTGATGCCATGATCAAATTGTGC
CAGGAAAAAAATTCAGGAGTGACTTTAGATCATTTCATATTTGACTTGATGGCATTCAAAGCAACGCTATATTTT
TTTGTTAGAGTGGCCAAATCGAAAAACGGGGCATTGCAGTTGATTCAAAATGAATTGTTTTCAATTTTGCATCAG
TCGAAGTTTTTGCAGATTGATCCAGATATTGGTTTAAGTTTACGAATTGAAGAAGTTCAAGATCACAAGACTGTC
AATGTAAATGTTTTGCTAGATACTCCACTTTCGATAACTGACTTGGTGGATCCATACAAGTTGCGAAGTGAAAAC
ACTATATCATATTTTGAGTTCCTTGTACCAATATTTCAGCTACTTACAACAGTGTTATTGTCAATGGGACCAAAT
TATCAACCTGCAATTATTCAAACTAGAGAACTTATGAAGAGTGTAAATCGATTGGTGGTAGGTGTTATGAAAAGA
GATTTCTTGGTAGAGACCAAACAAATTGGTCAAGGGTTGTACAAGGAAGAGAGTCACGAGTTGGTATCGTTGAAA
GAATTGGTGAAGTTGTTTATTTTGATTGATTCATTAGCTCATTATAGTGTGTAGTTGTGGTAGTGACACGACCAA
ATATATTTTGTTCTTGGAAAAAAAAAATATTTCGCCTTCTCCGAAGATTACAGCAAACCATATCCATAACCAATC
AAGTATGGCCGACAATACAGAATTTGAAAAGACAGATCCATCAAAGTTTTTGAGTGGAATAATAGGGTCTTCTGT
GAGTGTAAAGTTACACAATGGTGTTAATATAAAGGAAATTTGCAGACAATTGATGGGTTTATGAATGTGGTATT
AGATGAAGGTAAAGAAACTGTCAATGGGAAAGTGACTAAAAAATATGGAGATGTGTTTATTAGAGGGAATAATGG
TATGTATAAGGAAAACTATTGGGATATAAATAGCGTTTTACTAACATTTCGTTTCTAGTGTTATATATAAGTGAA
GCTTGAAGTAGGTTGTATAATTAAATGTATTTTAGTGATGTCAAATGCTAATGTCTGTAGGAATTGAGCGCAGAT
TGGACGAATCATATGTCGTCGTGTAGTCCGTGCGAAAAACTTTTTCTGTTTCAACCCACACAACAAACAACCAGA
AAAAAGGAAGAAGAAAAAATCTATCAATCAAAAAGTATTTCACTTTCCTACAACCAACACAGTAACTATTCCAA
AGATGTCATTCGTGATTAGAAGACAATTGTCCACTTTGATTCCTCCAAAGATCGCATCAGCAAAAGTATGTTAGG
ACTGCTAGAAGTGTGTTGAATTAGGATTGATTTACTAACGTTATCATTATAGAACCTTGGATCCAACCCAAATGC
CAAAAGAATGGCTGAAGTTGTCAAGTTCTACAACAAGTTACCACAAGGACCAGCTCCAGCTGCAAAGAAATCCAA
CAATCCATTCGCCAGATACAGAGCTGCTTACTTTGATGGCGATAATGCTTCTGGTAAACCATTAGTCCACTTGGC
TATTGCCGTTGTTATCTTTGGTTACTCCTTGGAATACCAACACTTGAAACATGCTCAACATGAAGGTCATTAGTT
AATGTTCATAGATTAAAAGAATGTATAAAAAATTTGAAGTGATATTTAGTCTTGTGTGGGCGAAGGGTACACGAC
CATTGTAGTGGGAGATAGTTCTGTTGAGACCAAGAATGGAAACGCATACGACAGAACGAGAAAACAATGATCGAC
CACACCGCCTCCAATCAAACAACAGAGGCAAAGTAGGCGTTTCTTATAAAGAATTGTAGTTCTTTTAAGTGTAGT
TGTAGACAGTATTCATAAACCAGGTGCGAGCAATCTGAAACTTCCAGTAGTAGTGGTGGTGAGAGAGAGAGAGAC
CCCTTAAACAAAAAAAAGTAATCTTACCAAGCTGGCTTGCTCAAGACTCATTTCGGGAAAGAAAAAAATATCCA
ACATTTTTTTTCCAAATTAGACGACAACAACACAGGTAATTGATAACATTATCATCAATCATCGAAGGCTCACG
TTATAGTTGCTTTGATTGGGTCTGATTTTTTTTTTTTTTTCTAATCCACCTAAAACAAAGAGCTAAACGCACTGA
CTAAAACGAATAAACTAATCTTGGACATTCCATTTATAATCAATTATGAACAATCAAGACCCAGATTCACAATAC
CATAATAAAAGGTGTATCCACCAAATCTACCATCAATTCCACCTCCACCGCAACAACCTTTGAGTGGAAGACCT
GCAACACCAAGAATGTTACGTAGTATAAGTGGCACACTAAAGTCTAAAACAGAACTTGCTCACTCTGACAAGGGT
CAGGAATCGAACAATGAAACCAAAAATAGCAATTCCCCTCACTATGTACCTGATACACATACCAGACAACCACCA
CCAGAATCACTCAAATCAAATATTCAAGCTCCAACAGCTGTTCATGGGAATCAGCAAAAAGGACTGTTGTTGCCA
CCACCATCTATTCCGAATCCAAACACTATGAAACCTGCGCCAACACCAACTGGAGTCGACCAACCACCTGCAAAA
CAAAAACCACTGCCAGCACCTAAACAACCACAACCACAGCAACAGCAGCAACAACAACAGCAGCAGCAATTTCAT
AGAAAATCTATTGGTGATTGGAATTTCGTAAAGACTATCGGTGCTGGGTCAATGGGTAAAGTGAAGTTGGCACAA
CATAATGCCACACATGAAATTTGTGCCGTTAAAATTATTCCTAGGGCAGCTAAACTTTATCAAAGAGCACATGCC
AACGACCCTCCTCCGCAAACCACACAAGAAGCAGCTCAGAGACATAAAGAGTTTGAAAAAGAAGTTGCGAGAGAC
AGAAGAACTATACGTGAAGGGGCATTGGGGAGATTATTGTATCATCCTTTCATTTGTCGTTTGTATGAGATGGTA
CCTATGACAAACCATTATTATATGTTATTTGAGTATATTGAAGGAGGACAAATGTTAGATTATATTGTTGCTCAT
GGATCGTTAAAAGAACGACACGCTAGGAAATTTGCCAGGGGCATTGCATCAGCTTTAGATTATTGTCATCGAAAC
AATGTTGTTCATCGTGATTTGAAAATTGAAAACATTATGATAAACGAAAAAGGTGACATAAAGATTATTGATTTT
GGGTTGTCTAATTTGTATGCACCCAAAAACTTGTTAAAAACGTATTGTGGTTCGTTATATTTTGCTGCACCAGAA
CTATTGAGCGCCAAGCCGTATATTGGGCCAGAAGTTGATGTGTGGTCTTTTGGGGTTGTGCTTTACGTTTTGGTG
TGTGGAAAAGTACCTTTTGACGATCAGTCGGTTTCGGTTTTACATGAAAAGATTAAAAAGGGAAATGTTGAGTAT
CCTGCTTTTCTTTCCAGAGAATGTGTGTCATTGCTTTCAAGAATGTTGGTTGTTGACCCCACTAAGAGAGCATCT
TTGTACGAAGTTTGTCTGCATCCATGGATGAACAAAGGATATGATTATAAGGTGAACAATTATCTTCCTAGAAGA
GAACCTTTGCGTTTACCGTTAGATCCGGAAATAATCAAAACCATTGCAAATTTTGAGCTAGGCACGGTGCAAGGT
GTCGCTGATGAGTTGACGAGTATTTTAACGAGTGTTGAATATCAAATGAGTTGTGAAAACTGGTACAAAATTACT
GAAACAGGAAGAGAGTATGCGTCTTCTCAGAATGCACAAATATTACCTGATCCAACTGGCGGGTTCCATCCTTTG
GTATCTATTTACTATTTGGTTGACGAAATGAGAAGAGGAAAAAGGCAAAGGAAGAGGCATTAAAGGCTCAAAGA
CGTGCTCAAGTTCCGACAATCGCTGTTCCTACACCAAAACAACAACAACAACAGCCACAACCAGCACAGCCA
CAACCACAACCACAACCAGAAGTATCTCAGCCATTGCCAGAACCAAAACCTGTACCCCTGAGGAGATAATCAAC
CCTGCAGTGGCAACACAGGCACAAGCTAACATGACAGCACCAAAAATTGTGGAAACATTTTCAGAGACCCCTCAA
AGAACATTGGACCCATCCAAGCAATCAGTGGATGAAAAACCAAGTGCACCAGGTCCATCTATTGCTGTTCCAGAA
CAAGCACACACCACATCTGTCCCATCATCGTTTGTTAAAACACAGACATCGATTGATGAAGATCAACTTTCATT
CCTGAACAACAAAGTCCAAGAACCTCTACCCCACAAACTTTGGATCCTGCAAAGGTGGTTGGCGGCTCATCTGGA
```

```
TCTGCTATATCAGCCCCTAATGCTGGTAGTGGTGCTGGCTTCAATTCTTTGTTAAGAAGATTGTCTTCGAAAAAA
TACAAGGGGGCCAGTTCTCCTAAACGTTCAACATCTCCACTGCCAAATGTTGAAGGGCTCTCGCCACAACCAACT
AAGGCCGACCCAATGGTACGTCGTGGTGTTAGTATGAAGGTTACTGCTAAAGAGAAACAAACGAATACAAGACCA
CCAAAGTCAGAGTTAATCAAAAAGAAACCGCAACATGGTCGTTCTTCCTCCACTTCAAACAAAATGCAAGGATCC
ATTCCTGTTGAGTATTTGCCACCATTACCAACCATTGATACCAATACCAACACGATTGTTTCAGACGGTGCTAAA
CAACAAAATTTGACTGTGCCTTCTACAGCACGTCATATGCACCCTACAGCCAGAGCAAAATCTGTTGGTGGTGGT
CATATGCGTAAAGATTCGTATGGACGCGTATCACACGGACTGCAGAATCCGTTGCCACCGCTTCCAACGTCTATG
GCAAGCCAGAATAGCCAAGAAGTTGTTGGGAAAGATACAAGCGAAGGCTTTTTTGATGACGTTCAATTGGATGAT
GTTGGATATCAAGAAGTTCCACAACTCACTGAATCGGAGATCATTGAACAGTATAATATTTCCAAACCTAATAGC
ATGCCATCAATTGAGCATTGTAAGACATTGTTTTTGAAAGGTTTTTTCAGTGTTCAAACTACATCAGCCAAGCCG
TTGCCTGTTATTAGGTATAATATAATTAACGTGTTGAGTAAGTTGGGAGTTAAATTCCAGGAAGTGAAAGGTGGA
TTTGTATGTATGCACACGCCTTCGGTACAGCCTAGTCACAGTAACGAACTTGATGAGGAGAATAAATTGTATGGC
GATGCCTTCAAGTCAAAATCGAGTGATTCATTTGAAGCAGCTGAACCAGAAGGATCAAAAACACCTAGTCGACAA
CCTTCACTTCAGTTGCCGTCTCATACCCCAACAACGCCATCGGGTCCTAAATCACACAAATCAAGTAACTCTATT
GGAAGCATTGGTGGAAATGTGCCAAGACGTAAGTTTTCCATTGGTAATGCGTTTAATACTTACCGTAAAAAGAAT
GGATCTCAAGTTATGATGCCACCAAATACACCAGCTACAGCTAAAGTGATTCATGGGTTGTATGACGACGACGAT
AAGGAGAGAAATGGTGAAGACGACGATGACGAAGATGACTATGGATATGATGATTCTGCTGATTCGCTCAATGGA
TATGGTGGTGGTAGTGATATGTTGATTTCTTCGCGTATTGAGCAACGTGCCAAACATCAACGAACTGTCAGTAGT
TCGAGTCAGAAAGCTAGCAAGTCGCCATTGAAGTTTGAAATTCATATTGTGAAAGTTCCATTAGTGGGATTGTAT
GGTGTTCAATTCAAGAAAATATTGGGTAATACATGGAATTATAAGACACTAGCTAGTCAGATTTTAAATGAAATG
AATTTATAGTTACATAGTTGTATTTATTTAATCTATACACCTTCGAACTGGTAATCTCTTTCAACAAGGGCGATC
CTTACTTTGAAGTAATCGTAAAATTTCGATTTCCCTAATTTCTGGGCCAATTGATGATCAGACTGTTGTTTCCAT
TGTTGAATGCTTGACTTGTCTTTCCAATAACTAATGGTAATTCCAATTTTGCTTGTGGGGTCGCGTGTTGACTCA
AGTCCAAGAAACCCTGGTTGTTGTTTGGCTAAAGATACCATAAGGTCTGCCACTTGGGTATATTCATCACTAGTA
ATGTCTGAGTTTAATTTGGAAGTGAATGATACCATATAGTATAGCGGGGTTGCTAAACTCATTTGTAGGTGGCGA
GGCAAGAAAAAGAAGAAGTGATGACTAATTTGACACAAATAAAAAATAAATTTAATCGAGAACGATAACTTCTGG
TTGTTCTGGTTCTGGTGTGGGATTAGTTTCTGTTTCTGGGGTTGACTCATTATTCAATTGTCTCAACTTCATTCT
TTGATCTCTTGACAATTTACCCGTATCTATGTTTTCAGTATTTTCAATTTCATTCTTCGTTCAAATCTTCTTTC
GGCAGCATATTTTGATTCTTCTTCTCTCTGTCTGTCTAATTCTTCTTGCCGTTGCTTTTGGCCTCTAAACGAGA
ACTTCTTTTACGTACTGCCAATAGGTTAACCATTTGAATCTCCTTACGCTTGTTTATTAAATATTTTCTCTTTTT
TATTTCGTTGTTGAAAATTGTGTCAATGATGGCACTAGACTTACCTGCCAATTTGGTATATAACAATTTATGGGC
CAGACTCTTTTTGATTTTGGTCAAATATTCGTTGAACTCGTAGATGTTCTTGTATATCAATTCAAATTTAACATC
TTTAACATCAAAAACTTTCTCCTCAAAATAATCTTGTGGTGATTCAGGTGATAATTTTCTTTTCTTGGGAATGGT
CAAGGGATAATAAGTTATTGTTCGTTTGTATAATCGATTATCATCAAATAATGAAAAATATTCAGTCAGTGACAA
TTTGAATAGTGGGTCAAGTCTAGTTGCTAGTCCCTGTTTTCCGTCCAATCTCTGAACTTGGAATACTTTGAAAT
GTAGTTAATTAAAATGTACAAGATGTCAAACTTCTCTGTGATGTTTAGAAGGTCAAATTTTACCGAATCTTGTTC
ATTGTCTGTTTGGACACCAAGTGGAGAGTCACTCCCAAAGTGACAACGGAACACAAACTCAAAATCTTCTAACTC
AACATGTTTAGAGTTCTGAACAGACGTGATTAATGCCAATTTTAATTTATTGATGAATAGACTCGATAAATCGAA
TGCACTGAAAAAGCCCAATAATTCCAATTCAAATAAATCAACATCAAATAACTCTGATTGGAGTTTTAAATAGCC
TCGGTAATTGTAGAGCCAGTTGATAACGAACACGTATTTGTTGCTGTTTCTTAACGCAACTAACTCTGGTGTTTG
AAATCCATTTTCTTCTTGTTGGTTTAGTAAGATTATAGGTGTTTGTTTGGACAAGGATGCTATTTGGTCTTGATT
ACCAATATTTAGGGAATGGATAGGATGACTAGCATCTATTGGCACTGGTGTTGATGAGTGGCTTCGGGATACCAT
GGTTGTTTGTCAAGAAGAGCTTGAAAACAAATCGTTGAAAAATTATTAGTATATACAGATTGCTGGTGAGAATT
GGTCTTAGTACACGATTGGTATTATTTGCAACCAGGAGACGCGTACCAGAAGTTTTCATTGAAGCATAGTTTCTA
AATTTCTTCTTGTATATTTATGCCAAGCTATAGATGGTCTTAAGTGTTTTGCTAATGTTGATATCAATACTCG
CAAAAAGATTCTTGCCATAAACAAGCGCTGGATAAATCAACAGTGTTTGAAACAATAAAAATCTAGTTGTGTTTC
AGTGAAATGGACAAGAGCGCAAAAAATAAAACTAAGCAAGACAATGAAGCTTGTATTATTTCATCCATGCCTACA
ATGCTTGATTAAACAGAATGACTTGTAGCTGACTGTCAAACTACATTAGAAACCGAACTTTCCTCAGTGTATAGA
AAAAGATCAACCACACAAGTCTTAAACAGCGAATCTTGAATTTCTCTGTCATGGATCTTAGTATGGACTCCCCCT
AACCAATAGATGTAAAATAATTGTATATCCTTGTTGGGGCTGTTGCTAACAATTCTTATCTTATCATTACTTGT
TCTTGCATTATCAAACAACATCTAAAAAAAAGCCTTGTTTAGATTCATCAAGAGAGAAATCTTATCGACTAATCA
GGAATTTTGACGAAACCCGCAAATATGTCTTATAAGAAAATGTTCAGATAATAATAATACTGTGGTCAAACTTG
AAATGGGAAAAACCATGTTTTACGTCATTTACGTCATTATTGTTACTTGCTAATATTGGTTTAGACGAAGAGCAA
GAAGTGAGAAAATTGAAAGGGGGGAAATCCTAGCACGAGGGCGGAGTAAAAAAGGCGGAGCGGGGCGGTGGCAAA
AAAAAATTACAAAACAAAGCAACAACATTTTAGTGGATGCGTAAATAGTATCAAATGTTTCAATTGGTGGTGG
TGTCGAGCGCAAAATCAAACAATTCATTTGAAACAGGAATGACTTGTTTTTGTTGATTCTAGTTTGAAGTTTATT
AGACCATTAAATAGAGGGGGAGAGGACATAGGAGATCATAATTGTCATTAAATACAAGTGAAATCTAAAATTTGA
AAGGGGGTCTAGAACAACAGACCTGTTGAAATTTCAATTAAAATTGATCAAAATTTTTAGTGTAATTTGATATTT
TACAGTATGAGAAGAAGCACTGATAACGATAGATAAGTGATTGTAATATCTCTGATTTTACAGTTTTAAACTATT
CCGTAGTTGTCCATTCAGTGTCCCTTGACTATCCGAGTCGTCTCCCTCTTGTTACCATTATAGCTTAATTTGGAG
```

AATCTAGTTTATTATTTCGAGTACGTGTGTGTGCTGTTGTTAATAGTAAATGCACTGCAAAACCTTAATTCTACT
AGTTGATCATTCATTTTATTTATAAATGGTTTGTATAGGTGGCAGATATCCACCACGCTGCCAATACTGAAACAA
TGAATAGGAGGAAAATATGAAACTAAGCAAATATGTTTAATTGCAATTCAGGGAAATCCACCGTAATCCTAACGG
AGTCCATAAGAAATTTGTTGGCTATCGTTCAAAGTCTATCGTTTAAACTCAGATTTTGTAGAGATCATGTTGAAT
TGCGGATCAACAATTGAGAAACTTGCGCAACCCCTAAAACAGAATTTTGTTGAGAAAGTACGGAAACCGCCACCA
CATAATTAAAATAAGAAGAGTTAGGCTCAAGTAATTGCTCTTCAAACATAGTTAACCACCATGTAAGTTTTGCAA
CACGTTTTCCTCCACAATCTATTTCAATAAGCCAAGCAATTACGTTGAGTACTTTACTTAAGAAGATTAAAGTTC
AAGTATCAACTACCATGTTGTTGGAAAGACTTTAAACAAAGAAATCAAGAATCAGACCATTTATGGATCTACTAC
AGATACTAAAATAGGGGAAACTCAACCCAACCACAACAACCACAACCACAACCACAACCACAACAATAACTACAT
TCCAGTCGTTAAATCTTTTCCCAATTTCTTTGTTATAGCCACAAAAGCATTACATGGGTGAGGGATGAGATGGTA
CTGTATATTAACCCAACCATTGATGAGATGGATTGATTATTGTTGGATCTGGACTTCCTTTGGAAAATAATAGGA
AACTCTGAAAATAAGAAAAAAGAGTTACAAAATTGAATTGATCTGTTGTGTAATAAAGAAAAATGAAATGACGG
TATAAAACATCCATGTTAGTAATAAGTAAAAGCTTCAAAGCCTTTGCATACACTTGAAGAGTTGAGAGAATAATA
TGTGGAATGTAGAATGGTATTTTGGGCGTGTAGACGTGTAGTTGCCAATTTGCCCTTTCAATTCTCATTCAGTA
TCATTTCTTTTTTTTTTGGTACTTTTTGAGTTGGTTAATGTAGTAGTTACCCGTTTTCAAAGCTTATTTTAATG
TAATACCAAGTGATATACATTAACGATACGAATAACACTTAATCTGACATATAACTAAGAAACAACAACAGACAA
GAAATAAGTAAAAAAAAAGAAAATAAGTTATTATAGAAAGAATAGAAGCCAATAGAAATCAATAGAAAGAAAGA
AAGGAAGAAATTATTTGTTAAGAAATTTGTTGGCAGTAAGTAACAAGAGAGAAAACAAATCAAGACACAAAACCC
AAAATCATAAAAAAAATACAACAAAAAAAAAAAAAGAAAACTTAAATACAGAAACGACTGAAGACACAGCAACA
ACAACAACAATTATTACTAGTAGTATTATTATTTACTATTAAAAATATCAAACTAAAATATTCTCTCTCTCAT
TATCTTCTCTTCTCCGCTTTTAATTAGTAAAAATTTATTTTTAAAGTATATAAATTGATTGTAATATCCTCTTTC
TTTATTTCAAAAATTTTACTTACTTGTATAAATAAAGTATATCTTTCTGTCATTAATTGAATTTGTTTTATTTTG
TTTATACATTCTTTTTTTTTGCCAAATTATCTATACAACTTGAACAACTTTTTACCTTAGTTGTCTTCATAACAT
TTATTAATAGAGCTCGTTAAAATAAAGAATGGTTAATAATCTCACTTCTGGTATTGCAGCCACGTCGTTTAAACA
CAATCATCCTCAACATGCAACTTCCCCTCCACCAGCAATTTCTATAAATACCAGTTCACCAAGAATACCCAATCA
TTCCCCTATTTCACCTCCTTCAGCTAACAATAGCAACAGCAGCAACAATAGTAGTGTTTCGGGATTTCCATTTTC
ATCTACAGTGATTTCTCCTAGAAATAGTATTACATCGTTTAGTAACCCAACTAAGCAACTACGGGCTAACAGTAT
CAACAGTGATAATGGCAACAATAGCAATGGAAGAAGGACGAGTAATTCCAATTATTCAATCACTTCAACTCCAAC
TACGAACAATCGATACTCATTTAGTGAATATTCCAATGAACAAATTATTGATTTAATGGAAAGAGAACAAGATGC
TATTGTCTTGAAATTAATGAAAGACATTGAATTTTTAAAACAAGAAAATAAAATGTTACGACTGACTCCTGGCGG
TAATAGTGCACAGTGGCATTGCATCCCAGTAATAGAAGTAGTCCTTCAACACCACCAGTCGTCGATCTTCACATA
A

YDR377W_homolog_1 80aa PathoSeq: 1..80 (SEQ ID NO 642)
NLGSNPNAKRMAEVVKFYNKLPQGPAPAAKKSNNPFARYRAAYFDGDNASGKPLVHLAIAVVIFGYSLEYQHLKH
AQHEG YGR008C_YLR327C_homolog 8405bp PathoSeq: 1..8405 (SEQ ID NO 643)
TCACAAATGGGATCCAACTTGCCCCGGCAATCAGTCACAATTGGTTCGTCAATTTGGCAAATGTCGTGCAAAGAA
TACGACGAATTGATAAACACCGGGTTCAGGAGGTCAGGAACATTTTTGTACAAAACCGACTTGCTAAGAAGCTGT
TGCAGGTTATACACAATCAGAACAAAACTCGAAATGTGTAAATTGACGAAAGAGCACAGAAAGGTGGTCAATCGA
TTCATTAAAGAGATATGTCCCGAATTGCCCCAGCCCAAGAAAAACACTTTTGACTTGAACAGATTATATGAGGCA
CAACTTCAATCAAAACGATTCAAAACTAGGTTGAGCCATCAAAATTTTCTAAAGAAAAGTTTGAATTGTATAAA
AAATATCAAGTGTCGGTGCATAACGATGACCCAGACGATGTGACTGAATCTTCATTCAAAAGGTTTCTATGCGAC
ACGCCGTTCCCTGACGACGAAGTTGATGGAGACAAGGACCAATTTGAAGGACTTGAACTCAAAAATTGGGGAGAA
TCAACAAAACCACGAGTTGGTCCTACCCACGAACTATATTTCTTGGATGGGAAATTAATTGCCATCTCCATTCTT
GACTTCCTACCATCGGGCGTCTCTTCCATATATTTATTTGGGACCCCGACTATGCACATTTGAGTTTGGGCACT
TTATCTGGACTAAAAGAGATGCAAATGTGTGACAAGCTAAATTACTCGTGGTACTATTTGGGATACTATATTGAG
GATTGCGTCAAAATGAAGTATAAACTGAAATTTGGTGGTGAATTATTGGATTTGTGCAATGAAGTATATTTCCCA
TTAGAGATTGTTGATCCGTATATAAAGAACGGTAGACTATTTGTCATTGGTGAAAAGGACGACGAGTACGATTCA
GAGCTTGAGATTGAGAGTTTAGGAGCTCCGTTAGACTATAAAGATAGTGATTTTTATGAGAAAAAGCTAGTCAAC
ATTGCTGAGGACATTTACGGGGACGAAAAGGTCGAGGCAGATGCTAAAAAGGCCAAGCAAATCTTAAAAGTCAAA
TATCAAATTGATCTGAAAGACTCTCAAAAAAGATTGCCTAATGTCGTACCGGGAATGATTCCTCTTTGGCAAATT
CTCGAATGGTTTGATATGGGTACAATTGATGAAGAATTCGTTGTTGAAATATTTATGGGCGAAAAAATGTTTGAA
TATTCTCTTGGCGAACTTAATGGTGAAGGGAGAGCAATCGTGGTTGACTGTATCAGAGCTTTTGGGCTAGAAAAA
GTACAGGATATGGTGATTACGTTGTGAAAAACATATATTGTGTTTTTTTTTCCCGCAATGGAAGATTACGTCCA
TAGGGTGAGAGTATTTATGTTCAACTAAACAAATATTCCTGCAGCTATTCCCAATACGAGAGAACCAAATACCGA
ACCGGTGACCATCATACCATCATTGAGACAATCACTAGAGATTCCGTGGATAGAAATGTTGGAATAGTTTTTGGG
GCTATTTTTTTTCCATTTAGCCAAGGGTAGCAAGGAGTGCCGGTGACTCTTTTTGTTCTGGTCGCTGGGCCTAGT
TTCTTCTGGGCTGTAGACGTTGTCAGTCTTATTATATAACTTTTCTGTCAGAATTAACTCTTGTTGAGGTGGGTC

```
GGGGTCGGTATCAGAATGGTAAATTTCCGATGATAACGCTTCTACCTCGTCAAATTTGTAATCGGTTTCAAGAGG
AGTATTTAGTTCCTTTAATTGAATGGCGTCATCGGTTTGGGTGTATTCGTCAATCAAACTCTGTAGTCTCAACTC
GTTTGCCTCTTCAATATCAGCACAAGCAATTTTCGTCAAATTCGGATAATGGAACACCACCGACTTTCCAATAAT
ATAGGACTTTGATTTTCTGTTTAACGACAAATAAGGGTCGCTGTATTTCAACTCAAAGCAAGTTGTGTTGATACA
ACCATGTTTCCCCAGCAAGTCGCCCACTTGACAGTAGGCATCGTTTTTTTGTTCATCGCAAACTGGACTAGCATT
ATAAGGATTAAAATGCAACCCAACTGCTTCGCAATTGCCGTTTCCTGGAACAGACCGTTCATGTATATGGTAGAA
AAATGGTCCTTCATCTTTGGGCAACCCTGTCATATCAATATGGACGTTGACATGTTTACCTTCTTTAGCACTAAA
CACCACGTTTCCTTTGACCTGTGTATCACCTCCAAAGGGAAAGTCTGCAACAGCAACGACGTTTCTAGGGTTTTT
CTTGATTTTAGGTGACTTGTCTGAAGCAGCTATTGAAACTAGATAGATTAATATGATAATGGGAATAAAGATCAT
CTTGCTGAGACGTTTAGTGATAAATCTTCACAAAAATATGAAGATCAAGATTATTATGACGATTTTTAAAAGAAT
TTTAACTTAGATTGTATTAATTAGGTAAAAGAATAACTTTGGTTCTGTTCTGTTTGTGATGAAAGCTGCAAA
AAAAAAGAATAACAGCATTTTACAGCATAACCAATAATTATAGTTTGCTATTGTGTAAATTTTGGTTAATTTCGT
ACAAAAAATTGAACTAAAAATTATTCTCAGCACGCTCCATCCATCGCACATGACTAATCCCCGGACAGGAACTTA
TGGAACGATGCACAACGAAATGTGGCGCGACGACACACCACGCAAAAAAAAAAAAACATGACCTTTCTCGCCCAA
CAATTTCCCCACACTTACTCACACGAGCCAACACAATGAGTAATCCCAATCTTAGAAAGAAGCCAACAACCTGCT
AGGACAGCTCTAGTCCACCACTACCAAGCCATCTAAATCCATCGGATAAATTATCTCTGACGAGAATAGACTTTT
TTTGTGGAAGCAACAGATGCCTCACTTGGGGTTGTAATTTTTTTTAGGTCACACGTACACACTACATATCTCAC
CCCATACAAAAATCCCCAATTAGGTTAGTATTGTTTCAACCCCCCCTTATTTTTGCAAGTATAAATATGTCCATA
AATCCCGAATAATTGAATAAATTTGTTTCTTCCTTTTCTTCCTCATAATCAATTACATTAAACAATTTTACTTTA
ACTTTATTACATCATGACTAGAACTAACAAATGGACTGTACATGAAAAGAGACCTCAAGAACCAAAATGGTTTAC
ACACAATGGCCACTCCGATACCGATCCAACCAAAGTAAAGAAGAATGGTGCTGGTAAGAACAATTGGGGTCAACC
AGGTGATGAATTAGATGACAATGAGGTTCGTCATTACCAAAAGTCTTCAGGTAGAAGAAACTCCAACCACGAAAT
GAATCAGGAGAGATTAAACAACTTGAATGACAAATTAGATAACCAATTGATGAATTAGAGAATGCGGTTTTGTAT
TTATATATTACGTAGTTACGAATTTACGCTGACGATATATCTTCTCATTGTTGTGACTGTTCGGATTGTTGCAAT
TTCTTTTCAATCTCTGCTTTCCAACCCTTTCTTTTTTGTCTTTCTTCATAAGCCTGCTTGTTGGCCAACACTCTG
TTGACAATAAACTCAGTATTCATGTCGTCATACTTATGTTTACCTATTGTCTCGTAAACAGACAGATCGATTTTA
TCATAAACGCCTTTATCTATCTCAGTTGGACCGTGGTACACTTTAACAACCTTAGACTTGCCCAATTTGCTAAAG
AACTCTGGTGTTGGGACATATGGTGCGCCTAATATTATTCCATCAACATATCTGCATTGCAAAACACATAACGAT
CTTTCCAAAAGATTCATTATTGGGTAGTTTAGCCCCTTGTATTGATTGACCTCAGCATCATCATGAATACCAACA
ACAACTTTGGCTCCTAACTTTGTGGCCTCTTGTTGTACAATTTTGAGTATTTCGATATGTCCTGGGTGGAACAAA
TCAAAGCCACCGTCAATGTAGACAATATCACCAATCTCAGCTTTAGGACTAACTATCTCTTCCAATTCGCCACGA
TTCAAATAAACACCAGATCCTGGATTCAACCCAGTCTCGTCGGTGGCGTATCGTTTAAATCTATCCAAATTGTCT
TTGGTCAACAAGCTTTCGGTAGTTCTCAGAATTGCTGGATAGTGATGGTCTTTGGACATTAACAACATTCTGCCA
ACCAAATCAGTAGTGGAAATGTTCGGAGTACGTTTAACAACAACAAATCTGCCCATATCCTTGACTACCTGATAA
CAGTCCTCACCATTGGCATCAGTTGTTATATCGTCTCCATGAACAACATATGGACACCCATATTCATCCATAAAT
TTGGGATCAGTAACATATGGTGCGTTGGCAATTGCCTTTGTGGTCCATTTACATGCTTCAACAGCAGTAATTCTC
TCATCCAATTTAATAACTGTGGGGACCTTATTTAGCAAAATTTCTTCGTCCAAGTGTACACCAACATACAACTCC
TTACCCAATTGACGTGCTTGTAACATTGCCCCGCGTGGCCCTATCATATGGTTAGTACTTCAATTTTCAGCACT
GTCACAAATCAAAAAAACATACCATGGTGAGCAAAATCAAAGCACCCATCAATCCAGATTCGACAATTTTCAATT
CCTTCTGGCCTTTCGTACATTATTGTAGAGCTTGATTTGAAGAAAATGTGATATGGAACAAGGAAAAAAAAAAAG
TTGCAAGAGGATCAATATTTATTGTTTTGTCTTGATGTTCGCACACCTCGTGTACATTACATAATCTTACATAAA
CCCAGATTCTTGTTGGCCCACCCTAATTGAATTGTTGGTAGTTGGCTTTTTCTTAAATAGTCCAGTGGACTTGAC
TGTTTGTGCCGAGACCCCTGTACTGAACTGCCAGCGTTTGGCTGACCTTCATAAGTTCCTGCTGTCATTCTGGC
GCCTACGTAACTCACACCCTGGCCCGACACCTTATGTTTAAGCATTTTCTCTAAATAAATATAAATCATTCCTGC
ATTTCTCGTCGAACAAGCATGTAGCCAACCAAAAAAACTGCCAATCACCGGAGGAAACGTAATCAATAAATCAAT
CATTATATTCGTCTGTAGTTTTGCAATGAGCGTATTGGGCAAATTGTAATTTTTCTGTGCTATGTTTATCACTCT
AGTATGAACCCCATACATGATAAGTGGACCCAACACTGGAAATATCAAAACTACCAAGGGAGCCAATCCCAAACC
ACAGTCTAACCCCACAGCACAACTCCCTAGAAAACACTTGTCATCAGTCCATGCTTGTGATTGAATCTGTTTCCA
TACTTGCTGATCATGTTTCGTTGCTAAATCTTTGGGAAGACGACGCTTGTTCCCGTTCTCATCCTCAAAAGGGTT
AACCTTAGCATTCCAATGTTCTTCCCCATATTCGTTGAAATAATCCATTACAACATCATATCCAGGGATATTTC
CAATTGATCTTGAATTTGTGACATGTCGATTAGTTTGCTAGCAAAGGAAAAGTGATAAAAAAAAGAAGAAGCAAC
TGAAAAATACCTTCGCGGCTCAAACTTGAGTTGCGCTCAATTTGTCTATATTCACTGGTACCATAGTACCATTAG
TTTCCTTGTGACATATAAAACACGTCCCTTTCTTTTTAGCCTTATATCGGTCTAAGAAACAGGCTTTGCAAAATA
TGTGTCCACACTCTGTCTTTATTGGTGACTTATAGTCACTCTTACACAAGACACATTTAAATGGGATATCCTCTT
TCTCTTTAACTTCTTTTTGGCCACCAATTTCCCAGTCTTTCTTAATGGGGATCTTTTGCCTAGATTCATCTCGTA
CATGAAGAAACTTACACGTATCACCATACCCACAGTACCCAGTTTGTTGAAAATCTTTACACACGTCCGGTTGGA
AATCGGTGATAATGGTGGTTTTGATATTTGCTGCAACGGTTTTAGTTCGCCCTTTTTCGATTTCTGAGAAACAAC
CTCCACAGCAGCAGCATCATCACTAGAAGATTTGGACAAAGGGGTTTGTGGTGATGATCGGGGCATCACCACCGA
TTTTTTCTGTATGTCTGACTTCTTGGTGATGAGGGTACTCTTTTTCGTTACCTGAGTATCAGGTGCATCTTCACT
GGCTTCATTTATATCACCTATCTTTCGCTTAGATACCCGTGAATCCTTTATGACCCTCTTCTTAAACATGGAGCT
```

```
GGATTAGTAATTGTATAAAAGATCGACTTGCTTATTTTTTTTTTTGCGTGAAAAATCCGTGCTAAATCCTTCAAC
ACCATTCCTTTTTTTTGGCTACAACGATCTCCGGATTTTCAACTCTTCCTTGCCTCCAAAAAATGATTACAAGAC
TTATTGGTATAGCAAAGTCAGGGATCTATCGCACATACCTGACCGCTTCCTTCTATGAATTGTTTCCCAAAAACT
TTCCACATGGTGGCCCCCCACAAGATTCGTTTATTGTGAATGACAAATCTTTACGTCGAGAGTATCGTTCGTTAC
AGAGTGAAAGCCATCCAGACATTTCGTCAGATACTATTAAATCTTCAAATATAAACAGGGCCTATACAACGTTGA
AGAATCCATATACTCGAATTGCACATTTCATCCACTTGAAACTGCCCAATCATGTAAATATCACCGACGATGCGG
TGGCCAAAAAACTAATCAAGAATTACCAGCAAAAGTCAATGGAAGCGTCAATGAACTATAAGGAGATGCTTATGC
AGGTAATGGAAGCCCATGAGCAACTAGAATTAGCAGAGCTGGAAAACGAATTGGAGACGTTGGAGGCCGAAAACA
AAGAGCGTATAAAAACCACCGAAGAAAGGATCAACCAGTCACTAAAAAACACCCCCATAGATTGGGAAGAGTTAA
TGATGGATGCTATCCGGTTAAAGTATTGGGTTAATATACAAAACGGAATCAAAGATTGGGAACCAGGTAAACCAG
TCCATCTCACTCATTAAATAAGCTATTATTTTACCTCTTTATATTTATTATTATACACGAAAAGATGTACACACAC
ACATATACGTCAATTATTCTTTCCTTTTATACGTTTCTTTACTCGCTGGCCATTGTTCGATCGTCATCTTCTTCT
TCCACTTCGTCTTCTTCTTCGTCGTCTTCTTCCATCTCTTCGTCTTCATCTAAGTAGCTAATTGGAACATTATAT
TCACATGAGTCATACTCTTGTTTTTCATCTTCTGTCTTTGGATGCATTCTTAGCCATTTCATTCTTGGACCGGTG
GCACTCAACTCGTTGATTTTGAACCCAAACAATTTTAGCCCAAAATCATTCTGACTAAACTTTGTTATTCTTATT
CTACACTGGTTTTCAATCTCGGGAAACATCTTCACCAATAGTCCAGGAAACGTCGTTCCAAAGAATGCACCATCA
ATATTCAAATACCTCGAACTGGAAGGTATATAGATATCATTACAGCAAGGACAAAACAATCTCACCGTTTCTTGT
CCCGGCACATCAGTCGACCCAACAGGAATTAAATGCATACCGTCACAAAAATATCTTGGACAAGAGCCAAAGTCG
TTTCTCTCAAACTTGGATGCCATGGCAGTTAGACCTTGTTTGGAGACTATGTATCTGGCATGGATTAAACCATAT
AATAATTCTGCAGAATGTGCCAATAACGCTTTGTTTGGCAATTCTGATGCATTTCGTTTACTTGTACCATTCCGT
GAATCATTGTTATTGCTGGTATTGGTGGTTGTATTGTCAGTGTTATGATCTTCTGCCGTTTCAACTTGGTAATCC
AATATTGTGTATAATGCTTCTCTATAATAAGGTACTTGCAGAGACAATCCAGTTAGATTGAAATCATCTTCAATA
AAGTCCTGTGACACCTGTACAAAATAATCGTGACCAAACAATTCACAAAACTGTTGTATCCAAGGTATATAGTCT
TCTTCTGGATCGCTAGGCATTGTAGTTGATATCACGGCAAAGCTATGTTAATCTTAATTTTTTTTTTTCCGTTC
TTGTTTTATCAATGGAGGTAAAAAAAAAAAAAAACTAGTGGTGACAAAATTGTGGATAGACAAATTGAATACACCT
AAAGTTTGTCGATATGTATAATAATATTAAACAGACCAGTAAGAAAATATGGGAATGATAAACACCACTATTGTT
ATTGTAAGGGTTTTCTCTTTTGATTGTTTTTGTCGATGCTTAGGGAAAACTTGAGGCAAGAAAAATTTTCTTTTC
TCGCTGAGTGTTATGACTGAGTGTGTGTGAAAAGAGAGCTTTCGAAAAATAAAAAAAACACATACCACCAGAGAC
GAGTTCTACCAATAATGCTTTTACCTGATTTACATCCATATACTATATTATTATCAATATTTCTTGTGCTTGTAG
CAAAACAATTGGTGGCAACCATTGGGAAATCCACAATCCAAGAATTTGTATGGTTGGTATATTTAAAGGTTTCCT
CAAAC

YGR008C_YLR327C_homolog_1 79aa PathoSeq: 1..79(SEQ ID NO 644)
MTRTNKWTVHEKRPQEPKWFTHNGHSDTDPTKVKKNGAGKNNWGQPGDELDDNEVRHYQKSSGRRNSNHEMNQER
LNNL YGR034W_homolog 2004bp PathoSeq: 1..2004(SEQ ID NO 645)
CCTTTTTTTTTTTATTGTTCTTTTATTATAATATTCAGTCAATATAAATATCTCTGTCAATTTATTCAGCTTTAC
CACCTTTTCTTTGAATCAAAGCTTTTCTATCTTTGTCCAAATGTAATTTAGTAATGACAACTTTAGATGGATGAA
TGTTGATTGGAACAGAAGCACCATTTGATTTTTCTTTTTGTAATTTATCAACTTGAATAGCAAATTTCAATCTAT
AAACAGAATTAACTTTACCTTCAGAACCTTTTTTAGAACCTCTAACAACTAAAACTTCATCATTTTGTCTAATTG
GCAAAGATTTGACATTGTATTGTTGTCTTAATTCTTTGGATAATGGAGCAGATAAAAGAACTCTTCTTTCAACTG
ATGAAGCAGTGAAATAAGCTTTTCTAGCTTTAGAACGAGATGAAGAAACGTCTATATAAATGGAATTTTTGTTAG
TATTTTACTGAATGTTTCTTAGTCTTTGTTTTAATAGGAAAAGTAAGATAAGGAAGGAATATATTGAAGGGTTAT
GATTTGATTTGATTTGATTTTTCAAGTTTTCCATTCAACAAGTTTGAAAAATGGAATCTCCTATACATAATTTCA
TCAATATCCCCAAATTGTATTTTAATATTGAAATTCAATATTAAGGATGTTCTTTATATTCAGGTAAATCGTGA
AATCATTATACCTTCTTGGTGTAGTACTTCAGTCAATGGTTTGTTCTGAGAAAAAAACCCTCTTTATTGAAACTG
TATTAAACTTAATTCTTAATGGTTGTTGTTTGATGTTCTATCTCCTTTTCAATGTATATATTCCTTTATTTCTTT
CTTTTTTTTTTTCTTTTCCTTTTATCTTCCTTTCTCCATATCTAATTGAATATCTATTTCATACCTTGACTGAT
CTTGGCCATTTTTGATGATTATATGCTATCTAGTATCGATCCAAAAGGAATTTTTTTTGAAAAAAATTTGAATA
TCTTCAAATTGAGTAAGTGTATAGAGAGATGAATTTTTCGCACTGTGGTCTAGTGTAGCTCCTCTACTCAAAAAA
AAAAAAATATATATATATAATGTATTTGGTAAGACAAACTGTGCGTAACAAAAGTATTTCTGATACTGCATATAC
AGTACATTAGGGCTATAGCCCTAACACACATTTAAAATTTGGCATTTACCAAATCAACATCAAATTTCTTAAAAA
AATATAAAACGAATAGAAAAAAAAAGACTTTTAGTGAGCTATACTTATTACAGTCTTCTCTATATTGCCAAAAAA
AAAAAAAAAAGAAGCCAGGGAATACTCTTATTTCATTATAATGTGAAAGAAAATTTGGTGGGTTCAAAAATGAGG
GTATAATTAGCTCCCCGCGGGACTCGAACCCGCGACCCTGAGCTTGCTTGTCATGGTATTAATTTACACAAGACA
CCGGAGGCCCAAATGCTAACCAACTGCACCAGGGGAGCATATACTACGTTGTCACGTGACACGTTGCTGTCTAGA
GACCATAATCATAACCACTGCGCTATGTCAGTGATATCACTCAAAAAAATTTGACCTATTTTTCCATACCAGTAA
GTTTTTGGGGTGTTATTATTTAGAAATAAACTCAATTTACTCTAAGAAATTGATGATTATTTAGCTTTCTAATTG
TTTGGATAGTCTTTTGGTAAGCAGTTATAGGTATTTACAAGTTTATGTGTCGATAATTGTTGATGATAACTCGGT
```

ATAGCTATTTGTAAAAACTTGAACACATAAGCAGCAATTACAAAGACGTAGATTGTATGACAGTAAACCAAATCG
ATTGACATTATAAATAGTAAAAAAAACTCTTTCATCAATTGATGGTTATCTAGATTTTGAAAACTGATTGATAGT
TTCTCCCCCATTTGTAAAAAATTAAATTAACCTTGGAGAAGAAGAAGAAGAAGAAGGAGAAAAAAATCTCATTAA
AAGACGAAGACAAAGAGAGAAATGTGCCACCACCACCACCAAAAGAGAAATCCA

YGR034W_homolog 120aa PathoSeq: 1..120(SEQ ID NO 646)
VSSSRSKARKAYFTASSVERRVLLSAPLSKELRQQYNVKSLPIRQNDEVLVVRGSKKGSEGKVNSVYRLKFAIQV
DKLQKEKSNGASVPINIHPSKVVITKLHLDKDRKALIQRKGGKAE YMR273C_homolog 935bp PathoSeq: 1..935(SEQ ID NO 647)
TCTTCTTCTTCGTCGTCGTCACGTTCCATCTGATCGCCATCCTCACTGCTCATATTTTGTTGCTCTAAATGTAAT
GTATGATCAACTAAGTTGAGGTAGGCATACATAAAATTCGACAACAAAACTTGCTCTCTTAGTGAACGCTTAGGG
TTAGCAAGTTTCAAGTGTGACAATCTATAAATGGCACGCTCAACATGAACTGGAAATCTGTAGTCAAGCATCACT
AAAGTTGATTGAGATGGTGGTGGCAAGGGGAACCCAAAGGCTGAATCAGTAAACTCAATAGGCTGGTTGGCCCTT
GATGTACGTTTTATTGATTTCTTCAACTTTTCTTGGATATCTAATTTCTCTTTATCTTCATTCTTAGACAAAAGA
TCTTCCCCTTGGCTTGGTTTGACACTTTGCTCAGTTGCAAGAACCTCCTCTACTACCTCTTTGTTTGTATCAGTA
AGTTCAGTAGAAAGGTTCTTCTTTTGCATATTGTTCCGTTTTTTCCTGCTAATTGATTTCTTTTTGGACAATTCG
TCAACTTTTAGCATCCCCAAATCTTTGTTATCATTGTTATTTTGAATAGGAGTTTCATCCTCATCAACAATAACT
ATTGTGCTCTGAATGTTACGAGATCTTACATCTTCAACCAAGTCATCAGTACCAGAATCTAAAACATCGTCCTTC
TCCCCAAGAGTGACAAAGTCGTCTTTGAGATGTTCAATGTTGAATTGATGTATCGGCGACGAGGTTACAGGGAAC
TGTTCCTCCTGTTGCTCTTGACTCTCAACTCTTTCTGCCTTACGAGTGCCATTACTTTGTCGCAAATTCTCTTTC
TCCTCGATCGTCTGCGATTCGTTTGACACTAAATTCAAAGGTCGAAGCTTTTCCTTATTCACTGAATTCTCTTGT
TCTGACAATTTGGCCTTGATTTCTCTTGAATAACT YMR273C_homolog_1 98aa PathoSeq: 1..98(SEQ ID NO 648)
IKRTSRANQPIEFTDSAFGFPLPPPSQSTLVMLDYRFPVHVERAIYRLSHLKLANPKRSLREQVLLSNFMYAYLN
LVDHTLHLEQQNMSSEDGDQMER YPR028W_homolog 3616bp PathoSeq: 1..3616(SEQ ID NO 649)
ACGATATAATTGGGGGAACAATATATTGGTTGAACTTGAAATTTGTGTTAGATGAGTGAGTTTTGATATAAAAG
GGAGAGATATTGTAGAGATAATAAATTTCGTCACCTGGATAAGTAGAAGTTTATTCTATTTATATATCAAGCCTT
TTTTTATCCGCGAAGATAAGCATTGAAGGCTATGGAGCGGATTTCGAAACATCTGATAAATCCAATGAGTTTGAC
AACTAGTCTAGACTTGTTACTGCCATTTTGTTTTATTAGTCGTCACATCAAACAGTAAAGCAAGACATATATGTT
AGCTTGATGGACTAATTGCAAATCAGCTCATTAATTGAGTCAAACCCCACGACTACTACACAACGGACAACAAAA
CTAATCAAAGCGAATAAAGCAAACAATGAATGGAAGAACACAGAAATAAAGATTGTGTAGTGAGAAAGAAAGAAG
AGAAAAATGAGTTCTATTCCGCAGCAATGAAAGCAAAGAAGCAAAGGAAAAAAAAAATCTAATTCTAAGGAGTTG
GAAGAAATTGTAAATTTAACACACACAACACAACACAACTCCTAATAAATGAAATTTCTTCCTTAAACGT
CACATTTTGAAATTTTCAATCAAACAACATTCAAAATTTTTTTCTTTTTATTTTTTCTTGCTCTTTTTTCCTTCT
TTTCTTCTTCTTATTCAACCCCATTCTAGTATCTATTAGATATCAATTGTTATAATCTCAAATCATGTCTAGTTT
CCAAGCTCAAGCTCAAAATTATTTATCTCAAATTGATAAAGTATGTTTAATGCACAGATTTTCTCATTTGCCATT
TCAACGACTTCATTCTTAACCACAGTTTTGTTATCTTTTAAATTTCTCAAGATAACAGACCTTTTTTCAAGTCTT
TACGATATAAAATTCTTAAACCATCTACTAACGATTCCATTTCATAGTCTACTAAAAATTTCGGTGTTTTAGATC
AATTTGAACAAAGATCCGGTTTACCAAGATCATATGCTGTTCTTGGTGCTGGTGGATTATATTTCTTTTTAATCT
TGTTGAATTTCGGTGGTATTGGTCAACTTTTATCCAATATTGCTGGCTTTGTCATTCCAGGTTATTATTCACTTG
TTGCCTTGAAAACCACTACTAAAGATGATGACACCAAATTATTGACTTATTGGGTTGTATTTGCATTTATTAATG
TCATTGAATTCTGGTCAAACACCATCTTATACTATGTCCCATTCTACTATCTTATCAAAACTGGATTCCTTATCT
ATCTTTCCTCATTTGGTGGTTCTACTTTGGTTTACAATAGTGTTATCAAACCACTTTCTGATAAATATGTCAAAG
TTGAAAACCCAATTGCTAGCAAAATTCAAGAAACCGCTGAAGGTGTTTCTACTGGTGTCCACTATTAAGTTAAAC
CATTTTCTTGAAATGTTGTAATAGAGAATACTAGTGTAGCAATATTTTCTGAATTTGTATTATATATATATATAC
TTTATTTATGCAATTTTTTGAACTAAATATATACTTGATATATACAGAAAGAATTCATTTATTTCATTCATTGTG
AACATATACACATTCAACATCTTCCAATCCAGTTAATGCCAATAATTTGATCTTCTTATGTTTGATGAATTTATT
CTTAACAATGAATTTTTGTAATTTTGAATTCCATTTGAGTTTACGATAGTATGGAGTTAATTTGCTAATGTGGG
ATACACTTTTAGTTGAACAGTTTTACCATTGGCTACCGGACAGGCATACATTATTGATAAACTTGACGTAATATC
AAACTCTGGTGATATACGAGCTCCAGTTAATAATCCAACCATATAATAAAATCCAGCATATAAAGACAATGCCAT
ATTGTATTCTACAGCAAGCTTCTTAAGCATTGACCAAGTATAAGCTAAATCTCCATGAGCGTATTTGTTGTCTAC
GGTTTCATGAGTCATAACAATAATCTCTGCTTGGCGATTCATTTCATAACTGACATTTTCTGTATAAAACTCAAT
CCAATTCAATGGGATAGTATTGTTAAAGTGGTTTTCGGAGCTCGATTCATTATCGTCGGGGATTAAATAATGGGT
TGTGTCTAATAATTGAATAATCTGTGTTGGAATTGACGTTGCAAAAATTTGCGATAATTTTGGTTGCAAAGTTTG
CAAATTATCAAAATAAAAAAATTGTGATGCAAGTAAAGTTGAATCATCTTGATAAGAAACACCTTCAATTGGGGT
GATCTCCATAGAGGCATTACTGACAATGAGCAACAATAAGAGTAGTGATTGCATGGTTTAAATAAAACAATTGCC AAAAAAAACATATTTCATGGTGTGAGTATCGTAGTTTTACCACAGCAAAAAGAGACCTCATACACAACAAGAACT
TCTTTCTTAAACAATATGATTTAGACTAGAATAATAAACAAAGAGAAGAACCCAATCAAGTAGGTAACAAGTCAT
GAAAGACTAAGAGGACCGACCAATGAATAATCACAAATAATGGATTACTCGATATCAATTCTTTAGAACTTCATT
CATATATCAATTTTTACCCAGTGATGCAGAAGTCCTTACATAACTATAACCAAAAATAATATCACAAGCAGGATT
CATAACCCGGGATGAAAATATACCCGTTAGATCTGCCAAACAAATTAATAATAATCCATTTGATGTATTTTAATT
TGCATCCTTTATCTTTTAGGCATTCTGGCTTGATGGAACCAAAAAAAAAAACTCAATCAAACCTATTAATGTCCA
ATAATCTAGGTTATGATTGACGAGTAGATGAATCAAGGTCGTGTCCGTCGCGTACAAAAAGAAAAAGAAGTTGAA
GAAATTTTAGTTTTAAAGTTGTAGAATTTCAGAACTCTAAGAAGTCATTCTTTAAAACAAGTTGTACAGCCACTC
TCGAGAGAGAAAAAGATAAGATACAAGATTTCAATAGAAACATAATGATGTCATTTAATGTAAGCCTATTTCCAT
TATGCTGGGATTAAATTAAGTGAAAAACAATCTTACTGGAAAAAGAAAAAAAAAAGAAATGAGAAGATATAAATA
CGGCTGGGGGTAGAAAAATAAGAAATCCCGAAGGTTGCTGTCTCTCACTATGGTCGTGCGCCACTTACCAAGGA
ACGAAAATCGTGACAATTTATTTTTCCAGTTGCTTGCAATTTCAGTTACAACACTAGTAGTCAATGATATGTACG
ATTATGTAAAGGACATTAATGTTCGTCTGTCTGTTGCTAAATCAGTTTAGGTCTTTATAATTTTTTATTATTCGC
ACATGCTAATTTCAATTGGGATTTTAGTATCTCACTATTACCATTTGCAGCATAAATAGCAACTTAATCGATTA
AACGAGGCTGGAAAGACAATTAGGGAGGAGAAAATATGCAGATTCCACAGAGAGAATACATTTAGAGTGATGAAT
TCCAACAAATTAGACGAATGGAAAGTGAAAAAAAAGGGCAAGAAAAAGAGAGCAAATACCAAAATGAGCAATATT
GAGAAGTTTGTGGCGATGCGAATGGTAGCAGTTAATCTGCAAGTTTCGTGTAATTCATTGGATCATTGTTGTGTC
AGGGGGGGTGGGATAC YPR028W_homolog 149aa PathoSeq: 1..149(SEQ ID NO 650)
VLDQFEQRSGLPRSYAVLGAGGLYFFLILLNFGGIGQLLSNIAGFVIPGYYSLVALKTTTKDDDTKLLTYWVVFA
FINVIEFWSNTILYYVPFYYLIKTGFLIYLSSFGGSTLVYNSVIKPLSDKYVKVENPIASKIQETAEGVSTGVH YFR033C_homolog 24142bp PathoSeq: 1..24142(SEQ ID NO 651)
GAGGAAGGGGAAACAATTTATTGGGGAGGATGAAAGGTTAGCCCCTAAAAACCCCCACAGTGGGGGTTCCAAAAT
TTTGGCACCCTCCATCTTGGAAAAAAAAGGTTATCCACCTGCTTCCAAGTAAGAAACATTTTCCAATTGGTACAA
TTGATAGACAGGAAACTTATAACTGATCTCTTGTGAATATTCAAAAGAAAAAAAAAAGGGAAAAAGAAAAACTTT
ACTTAATCCAGCTTAGTATCATATATTTTAATCTTATTTAATTTAACGTTACTACTACCACCACTTCGATTTCCT
CGAACTACATATTCAGAACACACAATATCAATAATAGAATGTCATTTTTCAGAGATTTATTAGAATCAGTTGTTC
CAACTGCTTATGCTGAAGAAGTATGTATTATGAGCTTATTCATTATTTTTTTTGAACATGTAACTGTCGTTTTA
GATGGTTTATCTTTGCAAGCAATTTCAGTTATACTAACGTTACATTATATTTTTTTTGTTTAGCCAGTTGAAGA
CGTAGAAGTTGAACAACCAGAAGATGCTCCAGAAGAAGAAGTTTCCGAAGAAACTGTTGAAGAAGAAGAAGATGA
TGATGAAGATGATGATGAAGATGATGAAGAAGAAGAAAACTCGTACCTGACCCATTGGATACTTTGCGTGAAGAATG
TACCAAGACCGCTGCTTGTAAGCCATTTGATCACCATTTCCACGAGTGTATTGAGAGAGTCACCAAAGAACAAGA
AGAACCAGATTATGAACACAAACACTACAAAGAAGATTGTATTGAAGAGTTTTTCCATTTGCAACACTGTGTAAA
CGATTGTGTTGCCCCAAGATTATTCAACAGATTGAAGTAAATTAGATGAGAGATAGTATAACTACTGTGGGGAT
AAAACGTTTTTTGCTTTGAAAATAATAAGGACATAATTTCAATACGTCATATTCAATTTCAACTGGTTCACTTAT
TAGTATTAAGTTCCACAATCCCTGTCTTTAATGACCTTTTTCATTGCATTTTGCCCCATTTCCTACACTGCTGTC
TAATATCTGGTTGAATGAAAAAACTGAAAAATTTAGAAAAAATAACTATACATATAACCTTCTTCCCATTTGTCA
ACATCTTACTAGTCTGCCAATTTAGGATGTATATACTTCCGACAACGAAGTTTTATAAATGAGTGTATTTTCCAA
TGTATTCATATATATAATTAAAAAAAACTATTGTTATAACTCGTACTCTGGAGATAGAATGTTTGATCTAGTCTG
TAGTTGATCACGTGCATTTCTCAGCAATTGCCGATTAATTCTACGTATAATGCAACTTCTGACGAGCCTCACTTT
GACCAACTCAAAGAACATTCTCGAAATATTAATAAAAAAAACTACCTGATTAGAAATATCCTTAGTTTAGAAAGT
GATTGGAGAGAAAATATGTAAGTGAAAAGACCACACAAAGATGTATAGTAAACCCCCTTCTAGAAGGAAATTTGT
AAAGTATATGAAAGTTGGCAAGATTTATTCTACAAACCCATTCTGATGGCTCAATTCAACTATTGGATGGATGTG
TACATGTGTTAGCTTGATTTAGCCGTTAATAGTAAGTTGTAAGAATAATAATAATAAAGAAATCATCCGCCTCGA
AATGCATAAAATATGAATGAAAGAAAGCCGAGAATTTCCTAACTGCAAAAGAAGAACGAGGTGAGTGAGAAATT
TAGGCCAATTTGGAAAGCTCGACAACTTTAAATATTGCATATGCGCTTTGCATATTTCCGGTATATAAACCTATA
TTGTGCATAAATTGTGCATATTTTATGCATGATTGTAGCAAGACTTACACATAGCAAAGAAGATTTTGGCCAGTA
AAAAGGCTCTATTTTCTGACAATTTTTTTAGACAAAATATAAGTTTCCTATTTAGTACTAAGTATACTTTAAGTAT
TTTTCAGACAAAGAATCTTATCTCACGTGCTAAGTGTTTGAAATCACTTTAAAGTCTTCAATTATTCACATAAAT
AACCACTTTTTAATAAAAAATAAGCTCATATTAATACTTGAGACCCCTATATTACCCCTAGTCTTGTTTTTACTT
ACAAAATAGTGCTTTTTTAGAAGTTCTCTACTTTTTTGCAAACTTTCGCAGTAAAATGGGTATAAATATTGTCAA
AAACATTTTTAAAATACTAATCTTACTATTTTAACCTTAATCAACTTTATGAAAACACTCAAAATTGGTATTAAA
TGATAGCTCCATGTATCTGGTATACATACTACTACCAATTTTGAACAATAGAAGTCATTATCTACTGTAAAAGTG
TGTTTTATTGAGCTGTTTTATAGGGTATTATTACTACTTAATACTGTGGATAGATGATTTGAACAAAGTACACAC
CACCAAAAAAACAAATATGCAAGATGACTTAAGCAAAATTTGTTAGGGAATTCTCACTTTTCTACTAACAATTCA
GCCTATAGGAGCAGGGAAAAAATTGTACAAAATCTACCAAAGAGAGCTCTGACATTTTCAGAGACCCAATAAAAA
TTCGAGAAATACTATGGTACATCCGACAAAAAGTTGTTAATAGTTAGGATCTCGCGTTTGTTTACTTTTCTATAT
AAACAAACACCACTTTATAAGAAACCACAACAAATACTTAAAAATTTTTTTATTAAGTAAAGTCTTTAAAAAATCC

```
TAAGATATTTTGTTAGTAATAGTTGACTTGTAAGCTTTATAGAGGTCATTTTTATAAGTATTTACTATTAGAAAT
AATCAATATTAAGTGTAAACTTAAATTTCCTATTCATTTGACTCTACTTAGTGTATATACTAGGCAATTTAAGCT
ATATAAGGTGATAATTCTTAGTACATTATAAGTAAAACAATCAAGTATTCAATACTTTAACATTTGACTCATTTC
TTTTCAAATACTCAGCAAAAGATGCAATCAGATCGTCGTTGTTGAACATTCTGTAGTACTTAGCTTAAAATAAAC
CCATCAAAACCACTTTAAACCAATCTTGAGCACAACAATTTGTTTATTTAAGCTTAATCAACACCTTTTAGCTAA
GTTTTCACCTTCAAATACCTTCTGCATTGGCAATCACTATTGTCGATTCCAAATAACCTCAAAATTATGCTAATA
CTAGCTCTTGGATAGCTGTTAGACCCTTATCAAGCACCATATACTTTATTTTTTTGATCTTGGCCCAAATATATCA
GCAAAAAACAACCAAAAAACAACCTCATGTCCACAAACGATGCTTATTTTAATTTCTAGCACCACAATCTTCCCG
AAAAACCAGCTATTCTAACAAATTGTTAGGCTTTCTTTCCAAAAAACTCAATCAAACCACCAAAAAATACGTTGA
ACACCGATTCTTGTTAATTATTATTCAATTGGGATCTCTAATAACATCAAATTTGTTTTGAAAAAGCATAAAAAG
GATAAATTTCTGGGATTATACCTTATTTTAAGGAAAAATCAGCTTCAAAATACAAAAGATGTTAGTAATCTAGTT
TTTAAAATCAGATAATATGGCCCATAGGCATTCTAAATAATTGAATTGATACTCACCATTCATTTTTAACATCAA
TTATAAAAGAAAAGACTTGGAAAGTCACATTTGTTGTTGTTTGTTGAAAAAGAAAGAAAAAAAAGTGGTGGGAA
TATGGAAAAATTTTGTTTTGGGTGGATTTGTTTGTTTATAGTTCGTTGGACGCGAGATTTTGTCGGATTCTGGTT
TTTCTGACGAAAAATATTTGACCAAAAAAGACAGAAAAATATGGGTGTACAAAACCAAATTTATGCACACAAAT
TAAATTAGTAGGTAGTACAAAAAGAGTTGTCGAGAAATCCAAATTACTCTCGAAATTTATTGTGGTCAATTAATT
GTACACCATCACACTACTTTTACTTATTATCTGTCATTCTTTCTTATTATTAACTTTTAGTGTTCCGCACCACCA
CCACCACCACAACCAACAGCCAACAACAACCAACAATCAACAAGAACAAGAACCACCACCGGACCACTCAACTCA
CTCGCACTCCTCGAATTCTTTTTTCTTTTTTTTTCTGCTCTCTCTTACTCAATTTTTCTTTTTTATTTTCGAATT
CTATTATCATTCGAATCTTCTTAATCAATTGTTTGAATTTGAACTTGAAAACTTTGAACTTGAATCTGATTTTTT
GAATTTAATCAATCAATCAATCAATATTGAAATCCCTTAACTGAAATCAAAGGTGAAAATTAACTGAAATAACAA
AGCAAAGCACTTTTTATAAAAAAAAAAAACTCCATTGTACATATAATTAGTCTTGATTTCTTTGAAAAACAAAAA
AACGAAATCTAATTACTCAAAAGCAAAGTATTAATTAATCATGTCTACTTCTGAAGAAACTAAAGTCACCAAACC
AGTCATTGAAGACAGAATCTACGTTGGTAATGTTGATTTCAAAGCCACTGAAGATGAATTGAAAGAATTATTTCA
AGATTTAAAAGTCACTGAGGTTGAAATCCCATTCAAGGAGAATACTCGTGGCGATAAAGTTTTCAAAAGACATTT
AGGATTTGCCTTTGTTCAATTTGAAAATAAGGATGATGCTGATAAGGCCATTGCCACTTATAATGGTCAAAAATT
CCAAAGAAGAAACATTTTCATCAAAAAGGCTGTTCCACCACCAACTGAAGAAGAAAAAAAGGAAAGAGTTGAAGC
TTTCAAAGCCAAAAGAGAAGAAATCAAAAAGGTAAAAGACAAAAGAAGGCTGAAGCTAAAAAGAAGAGAGAAGG
GGCTACTGCTGACGCTGCTACTACTGCTAATGGTGAATCTGCTACCACTGATTCTACACCAGCTATCCCCGATGG
AACTCCTTCCAAGGATACCATTTTTATCACCAACTTGGATTACAAAGTTAACGTTAAAACTTTGAACAGTTTATT
CAAGGAATTGAAACCAAAATGGATCCATGTTCCATCTAGAAGAGTTCCTTATAATAGAAGAGGCCGTGGTGGCAA
GTTTAGAAAACCATTCAACAAGGGTATTGCATTTGTCAAGTTTTCTAATGAAGAAACCCAAAAGCAAGCTGTTGC
TGAATTTAACGGTAAAGAAGTTAATGGCAGAGAAATTATTGTTGATATTGCTATTGACTCCAGAATTCCAAAAGA
AGGGTCAACTGAAGAAGATGTTGATGATGAAGAAAATGCTGAAGCAAATAGCAATGGTAACTAAAACAATTAAGT
TAAATAAAAACTTATAACCATTAGGCTTCTTATTCTTGTTTTGTTATAATTATGCTATGTTGTTGTCTTGCATTT
TTACATTTTCCTAATGGGATGTGTCGTTCATATTGTCATTATTATTAGTATGTTGTTTCCTTTTTTTTTCCTTTT
GTTTGCCATTTGGTTATTATTGCTGTGTGTAGTATGTGTATATATATAGCCTTGTGATGTTTTCCATTTGTTT
GTTTTGGGCATTGCTGTATACGATAAATAAGGAGTTCTTAATTGAATTTTTTTCTTTATTTATATATAATGGTTA
TATAGAGATTGCCAAAAACAAAAGCAGAAACAAAAGTACAAACCAGTTTTTAGTGTACATCTCTGTGGTTTTCAT
GAATCATGTACAAAGCATAAATTGACAATGCAAAGTAGTTTGTAAAAAGTAAGACTACTAATATGGTAGTTCGTA
AGTGACTACTAATATGGTACAGACTCAATTATATTCTCATAATCGAAAAAAAAAAATAAGCTGTGAGAAATTCAA
ACTTACACCAAGAAGTTACACTTTGTTTTACCGTTCCTATTATCTGTTGCTTGTGTTGCCCAGTATGAGTTAAGA
ATGAAATTGTTTCCAGGTTCAGCTCAATTATTTACTTATTCAGTATAGTTGTGTTGGAGATGAAGGTTTACAAGC
TTAGATATGTTGAGGGTAACTAGATTATTTTTGAGCATTTTTGAAAAAATTTACCAGTAAATATACTACTCTCA
AAAGCATAGCCAATTACCAGGTACGCAGAAGTAGACACAAACTTATTGGAAGCAAACTCAAATTACTGGAAATAA
TGACATTCATTAAATTTCACCATCTTCATTGAAAAAAAGAAACCATGAATTCTATTATGCTATTAAACCGACCTA
ACAGTTATAGTAAACATTCCAAACAAAAGAAGATTGAAAGGGTCATATTTCCCGTGTTGTTTCTGGTTCAATTA
GAACAAATATGGATATACAAAACCAATACCTGGACACGGAAATATTGGATTCATTGAAAAAAGTTCATTTATTTA
CTGGAAAAGAAATCAAAATAAATTTAGCAATTTAGACACAGTTATTACTGAAGGTGGTGGTAATTTATCTCATG
GTGAAAGACAATTAGTTTGTTTGGCAAGATCATTATTAAGGAATACGAAAATCATTTTGTTAGATGAAGCAATCT
CCTCAATTGACTACAATACAGATTACATACTCTAACAAAGTTTAAGAGAACACTTTAATAATCTGAACATTTTAA
CTATTGCTCATAGACTTAGAACTATCATTGATTATGATAAAATTTTAGTCTTGGATGCTGGTAAAGTAGTAGAGT
ATGATAATCCATATGTATTAATTACAAACACGGATTCATTATTTTACAGAATGTGTGAAAATAGTAGTGAATTGG
AAAGTTTGATTAAATTAGCAAAAGAAGCTTATGTGTAGACATTTATGTATATTTAGTACATAATATTATAATAAT
AATACAATTGTTCATCATTTATTTTTTGACCAATGATTCTTCCATAGCATCAATCGAAGTTTCAATTTCATCCAT
TGGAATTCCACAGCTTAACGAAATTAATTTGCAATATTTATATAGCTTATCAGTACTTGGATACGTATCGATGAT
GGTTTTAGCATTTGGATTTTCCGGTAAAGGAACATTTTTGGTTAATTTAGAAATCTCATCCACAAGTTTCTTTCT
TTTGATTATTTCCACTTGTAGTTGCTTGGCTAACTCTAATTGTTCGTGCACATTGCCTTGTTGGTGGGTTTGATC
AATTACAAAAGACGAAGCGTCCAACACCTTTTCGTGTAATCTTTCCTTTGTCATTCGATAACTATGTTCAACTTT
ATCTAATTCATCCTGTTGATGCAACTCCTGATATGTCAAATCGTTCATCAACCGGTATATTTCTTCTTGGAGAAT
```

```
ATGATCACGTTTAAAAATCTAGATGCAAATCATTGCCATGAACTGAAGTAGGATCATCATCATCTGTTACCTGCTG
CTGCTGTTGCTGACTATCATCTTTATTTTGTTCCAATTCTTCAATCAAATGATCCAATTTAAAAAACGACAATAT
CTTTCTTTGTGATTCGAGTTTGATTTGATTAATCTGGCTCAACACTTTGAAATACTTTAATATCACTTCGTCTTT
CTCACTCAATTCTGAATCAATGGCATAAGCTAATTGTGTCATTTTTTCTGTAAGGAGGTTGGCAGTGGTATTTTG
CAAATTGATGGCCATTTTGGAATTGTGAAGTTGGGTCTCAAATGATTGGTTTTCGTTTGTGTAATCTTCCATAAT
GTCTTCGTCACCATCACTATTGTTACTTTGATCATGTTCCACAGGATCCAATCTGAGTACGTAATTATGTGATGC
CAAATAGTCTTCAACGGTACAAGAGACCAAGTTTCTTAATCCAAAATTAATAAATCGGTGGTAATTGATAAATAC
TTTAATACATTTTTTGTTCAAGTTGTGGGCAGCAATATGAAAGGCAGTGTTACCATCTGAATCTTGGTGGTTTAT
AAATTTGGTGACAAGCTCATCCTTTGTTAAGTCATCTTCCATTGCGTGTCCATTGGAATCCCCTGTTCCTGTCG
CTCATCGACAATCTTTTCCAATAATGATTCTAAGTAGTACTGAGCAAATTTTTCCCGTTTGTGCTTGCTATCCGT
GTCCACTATATGATGCAAAACGGTTTTGCCATTGGAGTCCACCAATAATACTGATTCCTTCAATAAGTCTAGAAT
TAGTGGGAAGTTTCTTAATTGGAAAGAATTGTTGAATTTAACCATAAACATTAAAGGTGTTTCGCCATTGTTATT
TCTCACATCTGGATTTAAGGAGTGGGTAAATGTTTTCAACAAAAACTCAACCATGTTTAAATTCCCCATAGAGCA
TGCCCAGTGGAAAATCGTATTCCCGTCACTGTCAATTGTTTGATATATATGGATTTTAGACAAGGGTAGTGGAGG
ACTAAGTAATGAATCTGGTATCGGCGATCGTATTTTATTATTGTCATCTAGGAAATATGACAATAGGCTTTGAAA
GTAGTCTGAATATATTTGATTTTCCTGAGATAAAGATATGCTTGGTTGATGATACGGCTGCAACGGCAGGTAGTG
GTTATGTTGTTGATTTGCCCGTTTTTCAAAAGATGTTCTTGAAACTCCAAATAATTCCTTTGACGTTAAAAGATC
TGCCTGCGACTCTAATCCATTTCCATTAGTCATTCCGCCAGGGTACTTTCTCCTTTTTGTTGTAAATGAATCGTT
TTGGAGGCCATCACCTCTACTACCATTATGATATTCCTCGTCATCGTCTGTTTCTACAGATGCTAGGTCTTCCTG
TCGAAGATTCATATTGTTGGTCATTATCTGTAACGCATCTTGCTCTGTATCGTTTCTTGCAAATGAAGGTACCAC
ACCAATAAATGAGCTCTTGGCACTATGATCATTTGCATTAAAGTCAATTAAACTTTTATTTATTGGAGTTGTGTC
TGAACGTTGTAAGGAAGGAGTTGCACTCAATGTGGCACGTTTTGGTCTACCTCTCTTTTTCGGCACCGTGGTAGG
TGGCACAGAAGTGCTGCTGCCAAAACTAGTATCTGACAAAGTTGGCTGCACTTGCTTTTCCTTTTGCTTTTTCAA
TAACAGTGCTTGTCGTTTGGCTACATTCAAAGCGGATGCATGATTGTGTTTTGGAGCAGGTGGGGGCACTTCTGT
TTGTCCTTCAATATATTGAAACTCAAAGATGGGTTTTAAAACGTCATAAACACCAAAGTTTCTGGCAATTGCTGC
TCCTAAATCTAGGGGAACATAGGTCCCCTGATACTTTCCGTACCCACCTTGAACCTTTTCGTGAATCCCAGTTTG
AACGTCTTTTTCCAAAATCCTTGTCCGTTTAGCCTTTGGAAACTTAGCAATCTTCAAAATATGTGTGGCATTTAT
CCAAGAGTCCTTTTTGCGTCTCATTATTGGTCCTTCCAGAGTGACAAACTCAAATGCGGGGACATTTGAATATGT
TGCTGAATAAATTTGAGAGTCTGACATCTAGTGTTTAGAAAGTGTTATTGATGTGATGGGTTGATAAATGAAATG
AGCGAATGCTTTTTGTTTCCTCCCTAAACTGTTGCTTGTTGTTGATGTTGGCTTATTACTAAATGTAAT
AGAAATAAGGGATGAGGGTAGGCGGTGAGGGTGTCAAATACTTATGCCTTAAATCTACTAGAAACACAAGTCAAT
TGTGATTAATATATGTTGATGTTAATTGTATCAATTGTATTAATGTAATTATGAACTTTTCGGTGTCGTTCTATT
TTTTTTTTTCTCGCTCGTTCTCTCTCGCTCTATCTGTCTCTCTGTCTGTGTATTGATAATATTTTGGAATAAAAT
TGTTAAACTTTCAAATTAAATGTAATTAGAGTATTTCAAATGGTGTTGTTTTTTTTAAGACATTTAATGAACGA
GTTTTTCTTTTTTTTCTCTTTTCTCACTTTTCTTCTTCCTCCCCCCTCCAACTTTGAACTGTCTGGTGCTGCTG
GTTGCCCTTAGTATGTTTTCCTTTTTTTCTTTGTTCTCTTGCTCCCCTGCCCAACTTGTTTAACTTATCCATTAA
TATCTACAATTAATAAGATGATAATATTGATTATAAACAGTTCTATATAATAAATATTTTACCCATACCATGCCC
CTAATTTCACCCAAATAGCACTTTAAACAATCTATAAAACACTACACTAATCAATATTAGTAACAGAACTCCTAT
ATAAGCAATGTATTTGCCAAGATACTCCATTGCACTTTTGGGTGAATCCTCTGATAAAGGTATTGT
TACAACATGCTCAGCAGCTTGATAGCAAATTCTTCTTCTCGATATAATCTCACAATCTCTTGGTGGTACATCTCT
TTTCAAAATACCCTTGCCTAACAATATACTTGTGTACAGTGTCAATGACGCATCAAATGCCAAGAAAAAAGTTTC
TAGAAAGATGGACTCTCTTTCTATACCACTCGTAACTTTTTCAACTCTTCTCACATTTTCAAACGTACTTTCGTC
AAATGTGACAATCTCGCCTCGGGCCATTTTGTCGACTGGGAAGGTTAATTTTAAAAACTGTTCGATTTTGGCAAA
TGAATCAAGAATAGATTTGGTTCTTACAACAAGTGAAGGAATCAACAACTTTTTGAGATTATCATAATGATTGAA
AAACAATTCAATACATGACAAACTTTTATAGACCGTTTCAAAGGCTTGGGTTGCAACGTCAATAATCAATAATGC
TGAAGGAACAATATCTCCTTCGTATGTTTATCCTCCCAGTTGGAATTGAACTTCTTGTATTCATGCATAGTAGT
GTATTGTCCAAAGATATCATTAAATCATGCTCTAATTTCAATAAATTTAGTTTTGACTTGTTGGCCATTAACGT
TACATCGTCATAATGGGGATTTTCCTCAAGAAGGTAGCATATATGGTGATGATATCCAGATACAAGTGGACTAG
ATTTTTCAAATTTATAATGGATCTAAAAACTGCATTATTTAGACAATATTTGAATATCTCGGGGTGTGTGATTAA
AAGTTGTTTGTCAGATTCCAAAAGATTGGAATCTAAAGTTATTCTTCTATCTCCTATTGTGTATGGCATGCAATT
AATACAACAAATAAATAATAAAAAAAAAATAAAGATTGGTGAAAATGCTAAAACTTAAATGCTAGTAAAAAGGTA
CAATAATATAGTTGAATTCAATTCGTTGATATCTATCCCTGTGTGTGTATGTACGTATTTTTATTGGATGGTC
CACCAGAGATAGCTTTTTTTTTAACAAGACCAAAAGTAGTAATAGTAATTAGTAACAGATGAACTTTGAGACGA
AATGGTGCAGTGAAGTGAAGGGAACCAAAAAAAAAATAACGATGAGAGTAAATGTCGCATACACGGCATGATGTC
GTTGTGACATTTTTGTTTGCCTCTTTCAAAAACAAAATTTCAATTGCTACACGTAATTAAGTTGTGTCATGTTAT
TATTATTCTCCGATTACTATCTTTAGTTTTCTTTTTCTTTATCAGAAAGCAACCATTAAGAAATAAATATCATTT
GGAACTGCAATTGATTTTGATTCATTACACTGCCTTCTTCTTTTTTTTTTTTTCTTTTTAGTGATTAGATAAT
GGGAGTTTTCAGTATCTTTGGCTCCAAAGAGTCTTTCGACCCGAATGTGTTCGAAAGGAATTGACTTCAATTAC
AGAGAAAATCAATACCAACAAACAACAAATTAGCAAGTTACAACAGCGTCAAAAATACGTAAGAAGATCCTTGTC
```

```
AAGATATTTTATCATCATCTATCTCTGTATTTTTGGGTATTGTTATGCCACCATTCCTTCAAGTACTATCGGTAA
GAATCGAGTTCAGTGGTTTATAAGAGGTCAAACTAGACAACACTTGTTGGTGTTAATAGGATACCCGTTGTTTTC
AGTGTTGACTTTAAGGGCAGTCTCGTACATTTTCCAATTTTTCATCAATAATAAACAGAGCTATTTAAAGAGCCT
ACAGAACAAGCACAAGGAAAAGATCGAAGAATTGAAAAAGATTACCAACTTTAACAAAACGAATGAGTTGATCAA
TAAATATGGAAATGAAAAGCAACCACAGGTTTCTTTACAGAAACAAGAGCCTCAACCAATTTCAAATCAAAAACA
ACAAGATCATTTGAGAAACAGACATAATAAGCTGGGAAATCTCCGAGATCAGGCTATGAAAGAATTGAACTTGCC
AGAGGACAAACAATTACTGTCACAGCAAAAGGGGCAACTTCCAAATACAAAGCAAGCTCCTATTCCAGCAATTCC
ACAACAGCCAGCTCAAAGAACGATTCAAGACAGATTATTGGATATATTAATAGGTTCAGATAATAGCGAATCTGT
CGAAAATAGATATGCTTTGATTTGTTTCCACTGTTTTGCTCACAACGGACTAGCACCGCCACATACTGAAGATCC
AGCAGATGTTAAGTTTCAATGTTGGAAATGTGGTGCAATGAATGGTAAAGGCATGTTATTCGAACAGCCAGATAT
GAAGTTTGACTCTTCAAAGAATTCATCTTCTGAGTTGATAAACTTGGAGGTTAAAGAAAAAGAAAGTGGAAATTT
AGATCATCCAGGCACAGAGAATGAAGAAAAGGAAGAGAGTACAAAGAAGTTGCAATAATGAGGTATACAGATAAA
TATATACATATATCATATTAGCTAGTCAATATACACACGTATTATCTAAGACAAATCCATAATAGCGTTGACCAT
GTCACCGTCGTGATTTCTTAAAGCCTTGACAGCCTTGGCTCTAGAAACTTGGGTTTGTTCAACAACAATTTCAAT
ATCTTTTGGATCCAAACCAGTTTCGTCAATCTCACCTTCGTCTTCTTCTTCGTCTTCAGCTTTCTTGTCACCCAA
AGAAGCCTTTTCTAAATCAGCAGTAATAGCTTCTGGTGATTTGTCTTCGGTTTTACCGGCATCAGCAGCAGCTTT
TTGTAAAGCTTCTTGTTGAGCTTGTTGAGCTTGAGCTTCAGCAATTCTTTGGTTCATGTCATCAACTTTAGCTTC
ACCAAAGACAACATAAGTACCAGCAGCAGATCTGTAGACATCCGGGGAATCAATGGCATAAATCAAGTTTCCTCT
TTGTTTGAAAGTGACTCTGGAAATACCTTTGATTTGCTTCAAGTTTAACTTCTTGATCAATTCTCTAGCTTTCTT
TTCGTTTTTTGGAATGACATTAACGTCAGCACCTTGTGGGATTTCTTCGATAGACATAGTTATAGTTATTTAAGT
ATATGGGTTGATGGAGGAATAAGTTTAAAATGATTAGGGTTATTTTCCACTTTTTTTTTTCAGTGAAAAACTGA
GGTTTGTTCGTCGACAACAATTGAGAAATGAAGCAAAATTTGGGTGGTGTCGTTGAGCCCTAAAAAAAAATGAAA
ATTTTTCTTTTTCACCTCAAACATATTTACCCGGTAAACCTACCCTCATCAGAGCACTATAAATAGACCATCTCA
TTATCAAAATTTTTTTTCTGTTTTTCCCCTTCTTTTTTCTTTTCTCTGTCGACGTACTTCATAGGATCATTTCT
ATAGGTCACGTCCCTCTTTGACTCTTCAAAAGAGCCACTGAATCCAACTTGGTTGATGAGTGAGATTACCCTTGT
ACCCTCAAAGTGAGAAATAACATGAAATTTTTGCTTGACTGTGATTCTTTGCAATCTGGTCATCTACTTATAATG
TTTTGCCTTTGACTTGATGCTAGCCTTTCTTTTTTGAAGGTAATGCAGCTATTATAAAGGAGCGATGATCTTTAC
CCTTTTCATTGTGCCTTCTAGGAGGATTTTGAATTGGGTGGGTACAAGTGGCTGTCTGACAAGTTACAAAATTAA
ATAGACCTATTAATAATATACAAAATTATTACTATACATAACTTTCTACAAATGTAAATTTGAGCTTCTCAACAA
GCGAAGCCAAAAGGTATCCTTGTTTAATCAAACACATTTTGTCATCGTTTGACAAACCCAGATTGGAAAATTTTT
CATATCCAAATAACTGGTATCAAAAACAGGCATCTTAATACAGATCACAATTGCTAGAGATGAATATCTCAATTT
TAAACTTTATTAATTATCCTGGATATTCTGTAAAGCAGAGAGAAAGAGGGGGGAACTATTTGTTTCGTTATGGTG
ATAACGTTTGTTCGTTAGAAAAGCAGCAAATTTGATAATTCCGTGCAATTTCCATTATTCCGCTGGGCGCGGAATAG
GGAATAGCTTCCAATATACTTGGACAGAAAACTTTTCCGCCTCAGAGAAATCGCAAATACTGTCTCCAAGTTCGT
ATAGCTCAAACCATCGTTTGTTTTGATAATTCGTAGTGGCAATCCCATGATCATACTTGGTAAACGTTTTGAATA
GCTGTAAACTTAATTTGGCTTCCATGCTCAAGTGTTTCAATCGTCGAATCAAACCCCATGTTTCTATGATGCACT
GCACAATATCTTAAAATGGAAACCCAAAGATTTTTACATGATGAAAATCCCCATTTACTCAAAATATGATCTAAA
AAAGTTTATCATTGGTCAAACTGGGGTAATGGACAATTATCTTATCTATATTAGCACCGATAGAAACTAAAATAA
CCCACCTGAATGTAGACAAGAATAAGGAAAAGTATATAATAACAAGCCCAACCTCCCATAACCTCTTTTTACAA
AGTCGATTTTATTCATTTCAACTTCTCCAAAATGAAAAGTGAAAAAGATTCTGAAATTCAAGGTATCAACATAGA
ACCTATTGTTTCTTTTACTAAGGAAGACCTTCAACTTGACAAATCCCATGTGTTGACCACTGTTATTTCTCCTTC
CGGTAAGGAAGTCGCCATTACCAATGATGTTGACCAAGTTATGCAATTTGTCCTCGACCACCAAAATACAAAGGT
CGTATTAGACGAAGCCACTGACAAAAACTCCTTAGAAAAATCGACATGTATATGCTACCAGTGATGTGGTTAAT
ATAATGGTTCCAGTTTATGGATAAACTGTCAACTAGTTATGCATCAATATTAGGGTTAAGAGAGGATTTGAATAT
GGTGGGTGACATGTATAGTTGGATCGCTACGGCATTTTACTTGGGGTATCTTGCCTTTGAGTTTCCTGCATCAAT
GCTTTTTACAACGGTTCCCTGTGGCCAAGACAGTGTCAGTATTCATTATAGTATGGGGAATTATTTTATGTTTGCA
TTCGGTTCCCCAGTACCCAGGGTTTATTGCTTTGAGAACTATTTTGGGAATGTTGGAGCTGAGTGTGACACCTGC
CTTCACTATTATCACCTCTCAATGGTATAAAAAGAGGAACAATTTCTAAGAACTTCGTGGTGGTTTGCATTTAA
TGGGATAGGAACTATTCTTGGTCTGGCAATAGCCTATGGATTATATCAAAACGATGGAAACTATTCTTACCAAC
TTGGAAACTTGTATTTATAGTTACAGGCTGTTTAACCATCTTCTTGGGATTTGTCGTCTTGATACATATTCCTGA
TACCCCAACACAAGCATGGTTCTTGACAGATGAGGAAAAATTGTTGGTCGTGGAACGTATTAGAACTAACCAACA
AGGGTTTGGCAACACTCACTTCAAAAAGAACCAGTTCATAGAGGCTTTAACTGATTACAGATCATGGTTACTTGT
TATTTATGCTTTATCAAGTAATATACCCAATGGTGGATTAACCAATTTCAGTGGTATCTTGCTATATGAGGATTT
CCAGTACAGTGAAGCCAAATCACTCTTGATGCAGATGCCTCAAGGAGCAGTTGAAATTGTTGGTTGTGTGTTGCT
TGCCTGGTGTTCTCAATTCATTTCATCTCGATTATTGATGACAGTTTTCACAACGAGTTTGACAATCATGTCAGA
ATGTCTCTTAGCGTTTTATCCTGAAAAAAGCGGTAGACTAGTTGGTTTATATCTTCCTATGCTTGACCCTCTTGG
ATTTATTTGTTGTTTGTCGTGTGTATCCTCCAACTTTGCTGGACATACCAAAAAGATCACCACTAACGCAATGTA
TTTGATTGCCTATTGCACAGGGAATTTGATTGGGCCCCAAACATTTGTTAGTTCTCAAGCTCCACAGTATATTGG
TGCCAAGGTGGGCATGATAGCTGGGAGCAGTGTTGCTTTATTGTCTTTGATTTGCTTATACTTTTCCTATGTTTG
```

```
GGAAAACAAAAAACGGGATTCAAGGACGATGGTTGATATGAGCCACATTGAAAACTATGAATTCGCTGATTTGAC
TGATAAACAAAATCCAAACTTTAGATATAGCAAGTAGTGGTATAGCTCTGCGTAGTTTATTCAGTAATGCATGTC
TATTGAAAATGTATGATGGTTTTAGAAAGGAATCACTACATAAGAAGATTGATGATGCTAGGATTTTCAGTAACA
GAACGACTAAATGACTATTTTTCTTGTGGTGTCGTTGCACAGTAAAAGAACAGGATTACACAGCCATTACCCATT
GACCTCAGGCATCTGTTGGCCATGATATAGTAGTGATAAATCAAAAAAAGGGACCAAAATTATTGCCAAAAATAT
ACATTAGCATGAACTTATTGTATCTATTATTGGGAAAAAGATATGTGAATCAACAAGTATTGAACTTTCGACCTT
CATGACGGTTTGTGTTGGCTGTGAGTATTTTTGTGAGACTAGTTTACTGTATAAGCCTTTCAATGGTTTAATACA
GTCTGCCCTAAGGCAATTATTAATCAGGTCAGTATGCAATGCAGTATAATGCAAGGAATGTCAATCCTTTCTTTT
ATGTTTTGGCATGCTTGTTGGAGACTGCCACATAAAAAAGAAAAGGGAAATATCATCATTGATACTATATACCTT
TTCTTTTTACATTTATCCCTTCTTTTTTGTCTAGCCTTTATATTACTAAGTCAAGAGTAATATCCATTCTGTCAAC
AAACGGCGATGATTATTAATTGCCAAAAGTCGCATGCCAAAAATCCAGTACTCTTCACTCTAACTCCGTCTCCCG
AAGAATCCATTTGATTTGCGCCTAAATATTATTTTCTTTTACGATTTCTTGCAACGGCCGAAACGGCCCAGTTTT
CAATGTTTAGTAATAACAGAAATTATATAAATAAGAGAAACCCTGTCATCCTTCTCCATTCTTCTTTCTTGATTT
CATCCTGTGATTTTCAATTCAAATAACATTAGAAATTATCAAACCATCAAAAAAAGTAATTAATTACTACCAACC
ATAATGATAACGACCAGTTTAAAACGATCAAGATCTTTATTGAATAAGGTGTTACCTATCGATATTGAAGGTGAT
AAACATTCTTCTCCTTCAGTAGTAACGAGGAGTTCTCCAATTCTAAATCATGATTCAGAGTCTTTACACCTGAAT
AAAAGCCCAGCTTCCAAAAATTCAAATAAAAAAACATCTAAATCACCAAGTAGGCAAGGATCTAATAATAAAAAT
ACTAAGAAAACTAACGGGCATAAAAAGCGTCGCAATTCCAGTCATCAGAAAGAAAGAACAGAAAAATCGGAGCTT
TCACAATCAAAAAGAGGATCAGATATACTCGATCAAAGAAGTAAATTAGATTGGATTTTAATCGTGGCTATAGGG
TCTTTGATTCTTCTCATATACATTTTGAATTGATGAAAAATGAATACTGTGACAGCATTATTGTTATACCATTTG
AAAATGTATCACTGCTGACTAAGACACGACAGTATGCTGGATGGTGCTGATTATTGATAGGAAAGAAACCACCAG
TTAAAGTGATGTTCCATAGATATAGGACTACCAAAAAGTCGTGTGTAATGTTACGAGAAGCAAATATTATTAGTT
GTGTAGCAAAATTTTATACCAAGAGACAGAGAGGAAAAAAAAAAACCCAATTTCTTGAAATAATCTTTCTTTCAT
TCCATCTTTTTTTTTCTTCTAAGAATTCCTTTAATTTGAAAAGTTCATTGGAATCGTCAGATAGTCAAGTTTAT
CAAACATTCTAAATTAACTATCTTAATAATTTAGGGAATAGTGTATTATTTGCTTTAAAGATATCGGATACTTTT
TTTTCCTTTTGAGTTTTGTTTTGTTTGTTTTATTTAGATTAGTTTCTATTTTTAATTAATATTCTACATTCGTT
ATTGACGACTACAACATATCAACGACCTAGCACATCCACCCACCAAGATAACACAACTACAATCTATCAGACACA
TCTAGCAAAATGAGACAATTTCAAATCATATTAATTTCCCTTGTTGTTTCCATAATAAGATGTGTTGTTGCAGAT
GTTGACATCACATCACCAAAGAGTGGAGAAACTTTTTCTGGTAGTTCTGGATCAGCAAGTATCAAGATTACCTGG
GATGATTCAGACGATTCAGACTCACCGAAATCTTTGGATAATGCCAAAGGGTACACAATTTCTTTATGTACTGGA
CCTACTTCAGATGGGGATATCCAGTGTTTGGATCCATTAGTCAAGAACGAAGCTATTTCAGGTAAATCTAAAACA
GTTTCCATTGCCCAGAACTCAGTACCTAATGGTTATTACTATTTCCAAATTTACGTTACTTTCACTAATGGAGGT
ACCACTATTCATTATTCACCACGTTTCAAATTGACTGGTATGTCTGGTCCAACTGCCACTTTGGATGTCACCGAA
ACAGGATCAGTGCCAGCGGATCAAGCTTCAGGATTTGATACTGCAACTACTGCTGACTCCAAATCTTTCACAGTT
CCATATACCCTACAAACAGGGAAGACTAGATACGCACCAATGCAAATGCAACCAGGTACCAAAGTGACTGCTACA
ACCTGGAGTATGAAGTTCCCAACTAGTGCTGTTACTTACTACTCAACAAAGGCTGGCACACCAAATGTGGCCTCT
ACTATTACCCCAGGTTGGAGTTATACTGCTGAATCTGCCGTTAACTATGCTAGTGTTGCGCCATATCCAACATAC
TGGTATCCTGCCAGTGAACGAGTGAGTAAGGCTACAATTAGTGCTGCTACAAAGAGAAGGAAGATGGTTGGATTGA
ATGAGGGAAACGGTGCTTATAACTTAGATAATGCTAACATTGGATTTCATTTTTCATTTTTTTTTGTTTGGTTTA
GTTTGTTTATTAGCTTGTTAAACATGTAATACTGTGTTTGGTTTGTATAAGTTGATTGTATTTTTTTTTTTTTG
GCAAAGTAGATTTGAAGTAGGCTGTGTGGCGTGTCCTGCGTAGGTCGACGATGATGATGATGACGACGACGCGTT
TGTTTGTCGAATGAGATGTCTTTTTTTTGTCTATCTTTCCGTTTAGTACACAAAATCCATTTCTGAAAGCCCCC
TTTCTGTCGTATGCAGTATTTTTTTTTTCCTTCGCCATAATGAACAACAATGAAATGAAATTTTATTATCATTGG
GCAGTGGATTAACTTTATATGAATTTCATTTATTTTTTCGTTATTACTTTTTCAAAAAGAAGATTTAAGCAAAG
TATAATATAAATAAAGTGTTAGAGGTTGTTCCATTATCACAGATTAAACATTTATACTTTTAATAATCAAGCCAG
TATTGTTTTTACACATCACTGCCACACAACGAACATTGTCACCTCAAAATACCTGCTATCTGTTAACAAGCCACT
ACAGACTTTTAAAATTTTAAGAAACAATAACATACAGATCCAAGCTCAGCTCAAGACACAAGCAAAAAGACCGCT
CATACTTTATCCCACCACATGTGTATGAATCGACCAAAATATCAAGAATCTCAGTCAGAACCAAACAAACTTGAA
CTTCCTTTACAGATGCCTTCCACTAAATTTGATCTAGAAAAGCAACAATCACAGTCACATGACAAACAACACTGT
GCAAATAAGAGAAATTATCTTTATAAGTTGATTTTTTTATTCAACTTCATTAGTTTGTTAATACTAGGGTTGGTA
TATTATTCCACAGAAGTAAATCCTCAGATTTCTGCCAACCTAAACGAATTATTATATAAGATGGAGAAATGCAAT
GATTTATAAGCGGGTTCTTCGAATCGATTGCATAGGTTAGTTACTTGTTTTTTGAATATATACATACTTAAAGT
TGACTTTAGTAGATATTGTGACAATGGAATTGCGAGCGGAATTTCTGTGCGAACCAGTATCCTGATTAGGAAGGT
TGCGCGATAGTGCTAACAACCGCAAACACAGCTCCCGCAATTCCAACTTTCGGTACACATATATAAGTATACAAG
TATACCCTTCATTCATTTTGATAATCTACCCAAAAGAAAACCAGAAAATAACCCCAATTGTCCTCGGTTAGGAAT
ATTCAGATATGAAACTTTACATTTTTGTTTTGGTTGCATGTGTGTCATCACAAACCATTTTCAGATCACCATCAC
TTCTTGATCAATTATATGGAGAATTACATGGAAGAACAAACACAGCCAGCTCAAAATTTGCAGGTACAAGCAGGATC
CAAATCAGATGGTCACACAAAAGGTTTTAGCAATGAGATCCAAATTGACGTTGCCTGATAAAGATGATACTTCCG
ATATTGCTATTGATCAGAATATGTTTGGTGGAATCTTGACTTATGCCCATTTCAATCATTTCAATTGTTTCATTT
CTGATGACTTTGATAAACACTCCACTACAGATCAACAAACAACCAAAATATTGATATCGCTATTGTTGGGGCAC
```

```
CTTTCGATACTGGAACATCCTATCGCCCAGGAGCTAGATTTGGGCCCGAGTCAATTAGAAGTAATTCCCGACGTC
TAGGAAGTGCTTGGAAATCAACCAAAAAAAGATTCAATTACCCAGTTAACCCATATGATGAGACCACTCATAATT
ACTCTATTATTGATTGCGGTGATGTGGCTATGACTCCATTTGATAATCGCATTGCTTTAAATCAATTGTACCGTG
GACATAGAAGTATTTCTAAACACCCAGGGAATGTCAATCAACATCCCAAAATTATCACATTGGGCGGTGACCATA
CCATCACCTTAATGGCAATAAAGAACGCTCATGAACAATTGAGGACAAAAATTAGAGTATTTCATTTTGATTCAC
ATATCGATACCTGGGATCCTAAGAAATTAGGTGGTGGAATCACTGATTATATGTCATTGAATCATGGAACATTCT
TGCACTACGCTACTGAATTAGGATACATTGAAACAAAAGGCAACTATCATGTCGGGATAAGAGCACCGTATATCG
ATGCTAATTACGACAAACAGCACGATGCTGATTGTGGATTCCATATTATCCAAGCTAATGATATTGACAAGATTG
GAGTTCAAGGGATCATTGATGAGTTAGCAAAAGATCCAAACATTCCAACTTACATATCAGTTGATATAGATGTAT
TAGACCCAGCCTATGCACCAGGAACGGGAACAATGGAAGCTGGCGGATTCACGACCAGAGAATTGTTGAGCATTT
TGGATGGGTTGAAAAATAAGGTTAACGTTATTGGTGGTGATGTTGTGGAAGTGAGTCCTCCATATGATACAAATA
GTGAAATCACCAGTTTGGCAGCCACCAGTGTTGTCGATTCATTATTGAAATTAATGATTGTCTAAAGAAATAAAG
CCATTCCCTAACAAACACACACATACATAACTTTCTTTGTCACTGGTTAGAGTGGTTCACTTCATGTTGAACACG
CAGGAAGTTGATCTTTGACTCCAATTATTATCAAACATAAATCACGGAATACAAAATTATTGTTATTTAAGTTAT
AAAAAATATATAATATACATATTTACAATAAAATTATTCTATGTCATGTTATTGACTCCGTTGATATGTAAGT
ATTTTATTTTACGTGATTTATTATAATAAAATATGTTTTACTGATACAAATTGGGAAAAAGAGTAGAAATAATAA
ACTGAAGATTATTAATAATAATACCAAAAAAAAAAGAATACTCAACTATATGGTCCATATAAATGACAAACGGTT
AAACTGAGAACAAATCTCATTATGGAGTTCTTTTGTTTTTGTAATATGCTCATATGTAAGGCTTTTGAGGTGCTT
TTCACATCAGTAGTTTTCAGTTTCCTATCAAGTATAGATATAACAAAAAAAAAACAGAAAGAGTCAATAAAAGAG
CAATTTAAGTTGGCTTAAACAAACGATAGCAAAATAAATAAAATTGCTGCTAAAATCTATTTCTTTTGATGCCAC
CAAAGTAATTTTTTTTTTCTTTTTCTCTTATTTCTTCAATTTAGCAGCTAATACAAACGAATATATAATTTCATG
AATTAAAGCAAACCAAACAATCTTAAGTAATAATAATAATAATTCAGTATAAATAAATTGGGGTTGATCTTCTTT
TTTTTCATTTTGTATAGATGAGTTTTTCAATTCTGTTTACCCATTACAGCATAGATTTGATATTTTAAACCCTCC
TCCATTCGAAACTATTATTATAAAGAAAGAATGACATGTCAAACGGGGAGAAAATGTTCACTTGGAATAGAAGAA
CCTATTGATATCTCCTCCAAAAACGTGCCACTTAATGCGTTTTAATTTACACCATGTCAAGCACTCTACCAGAT
CACAATTCGACTAATTCATGGAATGAATATCACAACAATTTATCCATAACAAATAACACTCAGGTAACGACAAGT
TGTGCTGATAATGTGAAAACAACTAGCAATGTCCCTCGAAGTGCAACTGATATTAATTCCAAAATGACAACTTCT
GAATTCGAAACTTTACATAGATGCCGGTTTTCAGTGTGTGATTTAAATAATTTGGAGAATTATCTATATCAATCA
GAAAGAGAGGAATGCAGCAGAGTAATAGAACAACTAGAAACACACAACGGCAAAAGTATTAGCACTTGTTGCAAT
TCAAATACGGATATTAATGCTCAATGTAATCAAATGAAAAATCATAAAAGACGGAAATCGATTGCATTGAAATTT
AAGAAACCTCAAACATTATTATGATTGGTAGGGATAGGTGTCTGCTTTTATCTGTGGCTTGGATAGAGAGATA
TATGACTATGATTTAGAGTTGCTCACAATAGAATGTAGATATAAAGTTTATGCAATTTAATTTACAGACAATAAT
ACCTGTTAATGGAGAGGATATCCAATGACACCACTAACCTTGAGGGACTAGGGGTAAAGAGCAACATGCTAATA
TATATATGAACCTAAAGGTAAAATAGTCACTGTACGTACAAAAAAAAAGGCTCACAACAGTTTCTTCGCTTATTC
TGTGCCGAAATATAAACTATCTATAAATCTATTTCTGAAATGCCAATGACTATCCAAATGACTATCCTTCATTATTATA
CCAAACTTTGTTATTCGAATTTGAATCTTCCATACTTGATAATTTCCCAACAACAATTTTCACTTTAGGGAACAC
ATTAACAATTCTTCTTATACCAATTTCTGTAGATAAATACGTAATTAAAATAATATCTTGTTCTTTAACATGATG
ATCTAATAATACTTGAATTGCCATAATGGCTCCGGCTCCACTAATAATTTGTGAATCAAATAACATAATTTTATC
AGATAATTTATGAGGCAATCTTTCAAAATGTAATTGAGGTTCCCCCGTAGTTGAATCACTTTGAATTAATAATTT
ACCAATAGAAATTACTGGGAATGATTTTTTAATTGATGCCATGAAGCAATCTCCACTACGAATTATATTGACTGC
ATTATATTGATTTTGTAATAATTTTTTACCATGATAAATCCCTTTACCAGTATCGATATCGACATTGGTATAATT
GGTCATAAACTCTTGTGCTAATTCAATTAATAATCCACACATACGATTAAAATAAAATATGAAATCATTACGTGA
AGTTGACGTATCAAATAAAATCGAATTGATTCCCTTGACTTGATTAGTGTTTTGTAATAATTTAATATTGAATTT
ATCAATATCAAATTTTATATTGACCCCTAATTTCTTCAATCGTTGTAAATGATTTCTTGATTTTAATGCTAATTG
ATTCTTGATATGTTTAATCATTAAATTTATGGCAATTGAATTATCTAATCCTCGAGGAATCACCAAATCAGCATT
TTGTACCGTTGGATTAATGAATTTAACCGCATTTGGCTTAACAAATTTCTCCCATTGTTGCATAGCTCCACCTAA
ATCTCGACCACGATACAATATATCTCGAGTTAATCTTCTTGCTAAACAAATATCCAAATCTGTATCGACATATAT
TTTCGAATCCATCATATCCAATAATTGTTGATCATGTAAAGCATATAAACCTTCCACAATAATAACA

YFR033C_homolog 114aa PathoSeq: 1..114(SEQ ID NO 652)
EDVEVEQPEDAPEEEVSEETVEEEEDDDEDDDEDDEEEEETADPLDTLREECTKTAACKPFDHHFHECIERVTKE
QEEPDYEHKHYKEDCIEEFFHLQHCVNDCVAPRLFNRLK YHR001WA_homolog 1949bp PathoSeq: 1..1949(SEQ ID NO 653)
AAAGATAAAGTTAAAATCAATTACTATTTTTATTGGAAATTTTGTTGTTTTTTTTATCTATATTTTTATAACAC
AAGTATTATTGTTTATAAATCTAATAAACATTTTTCACTTTTTTCCTTATACTGGAACATCTTCTGGATCTGGGT
TATAAATCCAATGTTGACCGAAAAATGGGATTTTTTCATAAAAAGTCTTTTGGAATAATGGAACACCTTCAGTAA
AAGTAGCAACGGCACCACCAGCGGCAGCTCCCCAGAAAACCAAATTTGGAATGTAAGATCTGACTAATGGAGCAT
TTAATTTACCAAAATGACTCAAAGCTTTGTAAGCTGGACCTTTAACGTACTAAAAAAAAATACCGGCATGTTAGT
ATCAAGGTACTACTTTCTCTAATAATAAAAATAATGCTAATATTGCTCTTGATTGATATAAAACATATATTATAC
```

ATACTGAAACCATATTGTATTGATTAGAATAGTTATAAAGTTGAAAGTATTAACAGTAATTAGTTAACTGTGTCT
ATATTTTTTTTCCATTCTTTTGTTTTGAAGGATTGATTTTTTCTGCAAACTTTTGATTGGTCTTTCAACAGG
CTAAATCACGTGACAAGCACATTATCATTTTAATGGGATCGTTTTAGGTATCTACTTCAAGCATTCCTCAAGTCA
ATTAATTAGTTGATTAATATTCCTAGAACAGTAAAATATTATAAGCACAATTAAGAAAACACCATTGGTCTCAGT
TAATGAAATAAATACATTTATATCAACTTTTCTTCTTCTCTCACCCCGTATTCCTATTTCTCTATATTACATAAA
TATAAACAAACTAACTAAGATCAACGGCCAATCTTGTCAAGACATTTCTTTAATTAATTATGTACCGTTTTTTAC
CTGAATAACATTGTGTGCACCAAAGATAAAGGGCAAAACAATATTCTCTTGTCATTTACATACAATTGTCAAATT
TAACAAGAATCTGGTTGAGCTAAAATATAATCAATAGTTTGACCAACAGTTTTTAAACTATCGGCTTCATTATCA
GGGATTTGAATATTAAATTCATGTTCTAATTCCATAATCACTTCAACAACATCTAAAGAATCCAAACCTAAATCA
GAAGTAAATGAGTTTTGTTCAGTGATTTCACCTTTAGATTGATCTACTTTATCATAACCTTCTAATAATTCAATA
ATTCTTTCTTTAGCAATATCTCTAGTTAATTCTGGGAAGGCACTATAACAACGAATAAAGTTCATTGATGAAGTC
AAAGGAGTGACATTTTTGTTGTTAGTGATGGTGGTGATGGTGAATAATGATCTTGATGATGATTGAATGGTTTTC
ACCATTGAAGGTTTTGATACTGAAGCTCTTAATGATTTTAATAAAGTAGTTCTAAACATTGTTTAAATGAATATG
TATATATATATATATGATGGAGGGTTGGGGGGTTATGTTAAAGTAATAAGAAAGATGGTCTTTTTTTTTCTCTG
TTTAAAGAATAATTGAAAATATTACTGGACAAGAATCAAGAATCAAAAATCAAAGAAAAGTTAACTGTTACAAGT
GAGTGAGAGAGAAAAATTTTTTTTTTCTTTTATGATAGAAGCATATTGGTTAATCAAATACACCACCATACAA
TAATCAACTTGTTATGATTAGATCACTATTCAATGGTATTAGGTTAGTTAAACCTAATAATACCAATATCAATGG
TATTACTAGACCAATCACTTCATATATGAACTCAATAAATTCCAACATACCAATACTCAAAAACCACAACAACAA
CCTTTCATCATTCAATCAAGTTCGTCATTCATCATTAAATCAAATTCAAAAATATAAACATTATGATCCAAATTA
ACCCAATGTAACCAAGTCACCAGATTTAGATTATAATCCATTCAAAAAGGGGGGTGGATTAAGAATAATGGTTT

YHR001WA_homolog 63aa PathoSeq: 1..63(SEQ ID NO 654)
HFGKLNAPLVRSYIPNLVFWGAAAGGAVATFTEGVPLFQKTFYEKIPFFGQHWIYNPDPEDVP YJL166W_homolog 15790bp PathoSeq: 1..15790(SEQ ID NO 655)
ATGATAAAGGATTCGTCAAACTCTCTGAATTGAATTCTAAAGGACTGCACATAAAATATTGTAGATCCTGTTTTA
CAACAAGATAAACACAATTGTCTCCCGCACGTACGCACGCCCCTTTCTCCACCACCACATTTTTTCTTCTTGTTC
AATTTCCAATTTACTATAAATATCTTGCGATTCCCATCACCACCTCCTTCTCAACAATACAATACAAAAAAAAAG
CAAGCGTTCGAAGAAGTCCAACTTGAAAGAAAGCGTTACTTATATCTAGTGCAGATTATAGCTCGTTTGGGTTGA
TGTATGACATGAGTTCTTTGAAATTGGGATCGGGTTTATGAATTAACATGACAAAGATTTATGTCTTGAGTCATC
ACCCCTCCCTTTTGTTTAATATTATTAACAAACAAACAGGGTTTATTAACATTACCCACACATTCAAACATATAT
GAAAAATGATTAATATATGATTATAGCGAATCAATTCTTTAGAAATTGATTATTGAATTATTATCTTATCAACAA
AAAGATGTTTTATAAATATAAATATATAAATATATAAATGAATTGATTATATCGTTATTATTATTACCCAAACTG
AACATGTTCTCAATTATCATTCTGGGAAAATTAAAGAGGAAATATTGTCTTAATTCCAATTGATTTAAATCAACT
GATAAAAAATTGATCCCCCTCCCCCCCTAACACTTGTTAACATTGATTAATTGATGTTGTTGCAAATTTATACGA
ATTTTGATAATGGAAGTGATATATAACCCCTTCTTTTTGGGGTTATTGTTTTACAAACTGAGAAATATAGGGT
ACTATGATAGAAAGTATAACAACATTGAACGAAAACAATAAGATTTATCTATCTATTGATTACAAATTTCTTTCT
TTTGTTTTTATTTTGTTTAACTTATTTATTTATTGATATATACAAACATATATATAATAACATTATAC
TACTCCTTCTCAATCTCCACCCCCCCCCTCTTATTACCCTTATGGTGCCCAAATTTTAAAAGTTTGAGGAGTTTT
TAATGATAATGGTTTAAAACTATCATCTTGTAATTCAACATCAATAGTTGTGCTACCACCAGTTGTTGTTGAATT
TATTTTACTACCACCATCATTGACATCATCACCAGTAGTACTATTATTACTAGCAGTGTTATTGGTGTTATCACC
ATTTTTAATTTGCTCTAATGCACGTCTTGTAGGTTTATATAATAATGATTTAGCCTCATTCAATAATCCATTAAT
ATTTGTTGAATCACGAACTCCACCACCACTACCAGTGGCAGTGTTATTGTTATTGTTATTTGATTCAATTAATTT
AATGCTTCTTCTAATTTTTTTATTACACCAATAGTTGATTTTGTTAATGAAATTCGATCAATAAATAATTCTTC
TTGTTGTTTTAACATATTTTGTCGTTCACGTTCATAAATTTTTTCCAATTCTTCAACTTTATCAAGTTTAGTTTC
AATTTTTGAAATTTCATGATTAACTATACTTGAACCAATTTTATGCATTTCTCGTTCTTCATAATTTGAAAATAA
ATGACTCCTACCACCAATTATACCAAAAGTTGTAGCAATAGCATCTTTCCCACTTGATTGTCTTTCAACATTACC
ACCATTACCACCATTGGTGTTATTATTACCATTGTATACTTCTTGAACTTTGTTTTCAATACTTTCATCCATTGC
TTTTTTAGCAGCTTCACTAGCAGCTTTAGCAACATTACTATCAACTAATTTAGTCATAAATGTTAAATTTGCTAA
AACAGGATTATCAATTGAACTAATAGGATAATTAGATGCATATTTAATAATTTAATATTAGTTTCATCTTCATC
ATTTATAGGATTAAATTTATCTTCTAATGGTAATTTTAAAAATTCAAGTATACATTGTTCAGGAGTTTTATTCCC
TCCAACTTGATGAGCAATCTTATACCAATCATTTTTAAATGTTTTAACTGCACTAATTAAAGCATCTTTTTCTGT
TTTGGTCCAGCCATCTTCTTGGTGTTTCTTCTTTAATGGTGGTTGACTCCCTTCTATTTCTACTTTTTCTTCTTC
TTCTAATCCATGTTTCTTACCTTTATTCCCATTTGTTTTTGTTGTTGTTGTGGTGGTTGTTGTGGTGGTGG
TTGTTTTTCTTGTTTAACTTCTCCTGAGTTAGAATTAGAACTTTCATTCATCAATTGTTGTAATTTTTTCACATC
AACTCTTTCAACAGGTATACGTGAAGTATCAAAGGGGAAAAGACCTCTTGGTGTATCAAATTTAACATGATAATC
TCCAGTATAAGGTAAATCCATTGATTGTCCATTAGGCATTTTTCAAGGGCATAACCTGGTTTAAATTGAGGTCT
AACTTGATAATTTATTAGTCCCCATTTATTTAAAAATCTATGCACTCTCATTAATGTCCCAACATCACCAACTAA
ATTACGACGACATGAAGTTAAAGTTAAAAATTCATTAGGATTTAATCGGTAGGAATTTATCATGAAATTTCGATA
ATTAACATATAATTTAGGTGATTTAGATGGATGAATTGAATCAAAAAATTCTGGTAATGATTCTTTTTCAATTTT

```
ATGGATTTTTTTCATATTAAACCAACTAGCATATGATGGTATAACTATTAAATGTGTTTGTTTATATTGAGGTTT
TTCCTTTGGTGGTTCTTCTGGTTCATCTTCATCTTCCTCTTCTTGGTCATCTTCTTCATCTTCTTCATCTTCCTC
CTTTTCTTTTGATTCTGGTTCTACTTCTTTTTGTTGTTGGTCCATATCAACATCTTTATCAGTTGTATTTGTTTT
TACTTCTGAACTAGCAATACTAGTATTTTGGTTTGAAGACAAAGGTTCAGTCGCTGAAGCACCAACAACCGAAGT
TGTAGTTGGTTGTGATTCATTTGGGTTTTCTCCTGTACTTTCTTCTTTAATTTCAGATTCTTTTTGATCACTTGT
AGATTCAACATTTGATTTCACTTCAGATAATTCAGAATTTTTTTTCTGTTCTTCTTCTTCTTCTTCTTCTGGTTT
TCCTTCTTGTTGATTAGATTCTGATTCTACATCTTTTGAATAATCTAGATCATCAATTTCCATATTAAAATCGTC
ACCATTTATTAAAGCAGATGTGTCAAAATCATCATTAGATTTATCAGGGTCATTATTAGAATTATAATTTTCATC
AAATGATGGGTCATCTTCTTGAATATGTTTCAATTCTTCATCTTCACCCAATTCTTGTTTAGATTCTTCCTTTTC
ATATTCTTCAGTATTGGTGTTTTGTGTATTTGTTGTGAAAGCAATTGATGTTTCTTGAGGAATATCTACATCCAT
TTTATCTTGATTGTCATCAGCATCAACGTTGGTTGGTTCCTGTTTTTCAGATTCAGAGGCAGCATCGATTGCATC
TGGTGCATCTGGTATATCAAATTGCATATCATTATCACTATTACTGTCTTGTTTACTGTTATCATTGGAATTGGT
ATTGTCTTGATGTTCGTTTGACTCAACTTTATTCTCAGACTCAGCATCATCATCATCTTGTTGTTGCTGTTCATT
ATTTTTATCTTCAGTTGGGTTTGTTTGTGTTTCTTCGGCCGATTCTTCGGTTGACTCTTCAGTTGATGCTTCTGA
TAAATTACCACCTTCTTCATTATCATTTGCAGCATCATTGTTGTCTGAAGATTGTTTTGCTTCAGTATCACCATC
TTCATCTTCTTTTTCTTCCTTTTGTTCATCTTCATCTTCATTGTCTTCTGCTTCATTAACATCTCCTTCCTCATC
GTCTTGATGTTCTATTGATGATTCTGGTTGTTGTTGTTGTTCAGGTTCCTCAGGTATTGATGAAGTAGTATCAAG
AGGGGTTTCCTCTGGAGGTGAAGCACTCATATTGTCGAAACAGTAAAATCTATTAATGTATGTATATATATATAT
GAAAGTAAGGATAAATGATTAAAAAAAATTGGTTGCAAACTTAAAAAATAAAATATAATGAAATAAAAATAAAAT
AAACCTCCTGTGGTTGTTCTAATTGTTGCTGTTACTGTGTTTTGAGTTTGTTGTTGTTGTTGTTGTTTTAAA
GGGGAAGGTTGTTTTTTTTCTTCTTGCTTAATTTTTTTTCGTTCGTTCGTTCATTTTAATTTTTTGTTTGTCG
TTTGTTGTTGTCGTTCACACTCCCCCCCACTCCCACTCCCACTCTCTCCAAATTGATAAGTTTGAACAGTTGTAC
ACGCACATGACATTAGTTAAGCTTTCACTTATTAGTGGTATGGCAATATGTTAAACTCTTGTCTAAGCTTCAGTC
TAGACAAGTATGTCTAGTCTTTTGAGTAATTAGAACGTCTTTTTCTTTGTTGATATTAATCTCTAACTCATGATT
TTCATTATTCTTATTATCCACATATATTATCTTATAATAATTAAGGTAAAACAAAACACCAATAATGTAAGGAA
TTTAATAGGGAAACTGAACAGAGTAAAAGAAAAAAAAAAAACAGAGAACTAACTAATTTTCTAAAAAAATAT
TTGGCAAAGGTCAAATTCTTCTTTATATATATATATATATAGTAGTAGTAGTAGTATACTTGTAGACAAAGAGTAAAAG
GGCAAAATGGTAAAAATTAGGGCAAATGAATTTGAATATATTCAAAGAAAGAAAAAGGGGGAAAAAAAAAAAATT
ATGAAATGAATTTTAATAATTTATTTTTTGTTTTACAGTTTTTGGAATTTTCTTTTCCAATTATCCCAAATTATT
TAATGGCTTTTCGTTATATATTTATCTCTATGTTATATCCCTTTTATTCACTTCTCTGGTAATTATATATATATA
TATATATATATATTAATTTATTGAATTTGTAGTAGTTTGACAGTTGGGAAGTACGTTAATCATATGTGTAATATA
AATAGAGGAAATATTCAACTAACTAACCATCAGCCAAACAAGAACTGAAAAGAAATTATCAAATGACACAAAAAC
CATTAATCCATATTAAACCAAAAACCAACAAGAAAGGACAATCACAAAATATTAAATCATGCAGAATTATGAATA
TCAGTCAATAGGAATAAGAGAATGGGAAAGAAAAGGAAAAAGGAAAAAGAAAAAGTAGATGGGAAATTTTAACTG
CAACCTGTTTCTTGCTGTATAATTAGTATACTAATTAATTAATACTTGATGTTGATGTTGTTGTTGTCGCTGGTT
GCCGTCTGCTGTTTGCTGTCTAGTGTCTACTGCCTGCTATCTACTGTCTGCTCTTTTTTTTTTGTCTATGTAAAA
TATCTAATGGCAATATACTTTAGTTTTTCTCCTCTATTTAAACTAAACTGCATGACATCTATTTCAATCGGTTGT
TGTTGTACTTATGCTTGTTCTTGTTGTTGTGTAATTGTGGTATGTCATGCATTTAGAGAAACAAGTTACATTATG
CCCACTAGTTGTCACCAAGAAATTAGATGAAGCGATATATTAGCCCAAGATTAGAAAGCTTGTCCTAGGTATTAC
TTTTTCTCGTATGATATTCTCTACTACAAATGAAATTGCCTAACCAATAAAATGATAATTATTCTCCGTATAT
CGTAGTTGGAAATTAAATCAGAATGAAAATTCCACCAAACCAGAACCAGGAAAAAATAAAAGAAGAGAAAGAGGA
AAATTACATTATACCATCAAACAGGCGATTAAAGTTAACCTGACACAATAATAGAATAACTAAACTTGAATGCGT
GGGTAACACTCTTTACAATTCAATTGTTCACCTTGAATGAAAATCTCTTGGATGATAAATAAATATATCAAATAT
CGTTTACAAATTAACAATAACTTACAAATTGGACTAATTGATACACTTTTCATTGTTTGAATGGAGATATTATA
CTACTCGTCTCCAGAAAAATTAACTAAGTATGTATGTATGTTGTTGGTCAAACTTCCTTGATGTTGTAGACTGTG
AAATTGAAAAAGCCTTGTTAATATGTTCTTTCTGAAACAATCATGAAACAACTGTATTTGGAAATAACTAACACC
ACCCAATTAATAAAACAGTAAACAAGATATACATACTTAAATTCAATACTAATCTTAGTTTCCTTAGTTACCTTT
TTTTTCTTTGTTTTATTCCGGTTGACTATGTAACAATCTTCAATCAATTTCCTTTTTTTTTAGTTCTTCGTTCA
ATAATTATATCCTTACTCTTGACTCAAATATTATACAAATACTTGCCTACATTTGTTCTTCTTCTTATGATCACC
AATTCACTTCTTTCTTCTGATCTTACTACATAACTTACGTTGATGACCCTCTTGTGAAGTTTGTGAAAAATTGAT
TTTTTTTTTCTCTCTCCAAGAAAAATAATGAACTCAAAATCTAAATAATACTGCAATATAAGATATCAAGCATAT
ATGGTAAGATCATACTGAAATTGAAGGGCGAAAATATGGATAATCACATAAATTTCAACACAATCAATCGGAGTT
TAAAGATTGCACACACACTAGGAGGAAGAAAATTAATAAGAAAGTTTTGTAGTTTAGTTTATTGGCACTGTCACA
GACAGAATAGTAATTCTATATGTTTTCAATTTATTGAATTTAGCTTATAAACCAGAAGCTACATATAGAATAAGT
AAGTAAGCTTTCTTTTTGTTTATTAACTTGTTCTGATTTTATTGATTGCTCTTCGACCTGATCATAATCTTTTGG
AACAAATAAAAAAAACGACACTGTTTAGCGAAACTTGAATTAATAGTTTTTTCTACTTATTTGGTGCTAGATTTA
GAGGATTATATGTGTCCAATCTGTAAACAAGTTGATAACAGTGACTTCGTAATAAACTTCCCCGGACTTAATCTC
TATCACAAGTAAGTATAATCACTCTACTAATCTTTTTTTGCAGCAAATTTTTTTTTTTTCTTTCTGGTCAAACGA
TACTTTAGGGCTATAGCCCTAATCCAGTATTTCATCCTGCATAGATTCTTAGTATCCGGTCTCGCAATACAAGCT
ATATATAACAGTTTTTTTTTTCTAGTGACATCGCGGCGTTGGCTCCAATTTTGTCGCGCAATGAACTGAGGTATAT
```

```
GGACCTATTGTACACGATTTTTCAAGGCCTGGACTGGAAATATGGTCGCACTCATACCAATTTTGTTTAGACTTG
CCCCCTCCCCCCCCCCTCCCAGTTCGCAGTTCGCAATTCGCAATTCACAGTTCGCATTTACTATACAATCATTAC
TTAAGTACACAACAACAATTTCTTCTCTCCCCTTTGAGTTTGAGTTTGGGTGAGAACGAAAAAAAAAAATTCTAC
TAACAAAATATTTTTCAAAGGAAAAAAAAAATTTTTTACAGTTAACTTTTTCTCCATTGAAATCCACATTAAATAC
AATTCAACAATGGTTCGTTACGCTGCCACTCCTGCTAACCCAGCCAAATCAGCTTCTGCCCGTGGTTCTTACTTG
AGAGTTTCATTCAAAAACACCAGAGAAACTGCTCAAGCCATTAATGGATGGAAATTAGAAAAAGCTCAAAAATAC
TTGGACCAAGTTTTGGATCATCAAAGAGCCATTCCATTTAGAAGATACAATTCATCTATTGGTAGAACTGGTCAA
GGTAAAGAATTTGGTGTTACTAAAGCTAGATGGCCTGCTAAATCTGTCAATTTTGTCAAAGATTTATTAAGAAAT
GCTCAAGCTAATGCTGAAGCTAAAGGTTTGGATTCTAGTAAATTAGTTATTTCTCATATTCAAGTCAATCATGCT
CCAAAACAAAGAAGAAGAACTTATAGAGCTCATGGTAGAATTAATGCTTATCAATCTACTCCTTCCCACATTGAA
TTAACTTTGACTGAAGAAGATGAAATTGTTGAAAAACCAGTTGAACAAAAACAAATCAGATTGAACTCAAGACAA
AGAGGTAGATTAGCTTCTCAAAAACGTTTAACTGCTGCTTAAATAAATAAAAAAAAATGGAAACAAATAAGGGAA
TGAATTAAAGATTGATAGATAGATAAAAGAAATCAAGTCTTGTTCATTCATTCATTCATAAATTCATTTTT
TTATTATTTGGAGAGAGAAAAAAGCAAAATGTCCATGTATTGTATGTTGCATGTTTTCTCTAATTCTTTTAGCGG
TATGTTCATAATGTATATTATAATAATATAAAATCAAAATATTAAAAAAAGAAAGAGAAGAATCACTTTCTGGGA
TATCAATTAATAAGATATATGTGTAAATAACAACAAAGTTATTAACTCTTTACAAATATGTATATTTGATGAAAT
TTAACAAAATGTAAAGAAGTAAGGACATTTTACTTTATATAACGTATTTCTATCATAGTAAATACCTCTTAGACT
GTCCGATAACACAAGAGTTTAAAACGATATGGGATTAGAGTTTTTAGTTTTACTATTGTTATACTGGAAAATTGC
ATTCTTTAATCGCTCTTTCATGTAAGCCTGGAAAGCCGATATCACTTGTTTTAGTGAGGTCCCCCTTCCCATCTT
CTGGTTGTGGGATAAAGTTTCATATCATCATATCAACTATTAAAAGCCCCAATTGATGCAAATTGTGAGACTGAC
TTCATTTTCATCTACATTAACTGGTATACTCCGGAAATTTGGCATATTAATTATAATCCAAATCAACGATTAATA
AGCCTTAATATAAACCCTGGGTATATATATCCAGATAGAGATTAATTTTTGCTATATCATTTGATAGAGGTTTTC
TAATTGTTTCAACAATTGTTTTTGCCCATGTTTTTTTAATAGATAGTAAATTTAAATTACCAATTGATATGAGTA
AAAAAAAATCCTTAAAACTCTCTTCAGATAAACATAATATTCCATAATAATATCTTTCAAGAGTTTCAAAATAAA
CCATCAACCAAATATATGAAGAACGATAAGTATAAAGATTATGCTTGTTACATACCATAATAAGAAACAAACCTA
GTATATTCCTGCATATAGTCTGACCAATAATAGAATAGAAAATTCAATCTTACAAACCCACCCACCAAAGTGAGA
GAGAGAGAGAGAAAGAGAGACAACGAAAAAAAATTCAAGGAAAACTAAATATCCCATCTTTCCAAATACAATACT
GTCTTATCATTAATAACTAACTATTCAATAATGGCAGGTGCACCACATCCACATACTTATATGGGCTGGTGGGGT
AGTTTAGGCTCCCCAAAGCAAAAATATATTACTCAATATACTATTTCTCCATATGCTGCTAAACCATTAAAGGGG
GCTGCTTATAATGCTGTTTTCAATACTTTTAGAAGAACCAAGAATCAATTTCTTTATGTTGCCATTCCATTTGTT
GTTGTTTGGAGTATTTGGACTAGAGCTAGAGATTATAATGAATACTTGTACACTAAAGAAGGTAGAGAAGAATTG
GAAAGAGTTAATGTTTAAGATTTAATGATCATGATCATCAACATTTGGCTACATATACTACTACCATTATTGTTG
TTGTACTAAGTTTTCCCTTATTGTTATTAAATATATACATAAAAAAAAAAAAAGAATTAAGTCGATTTGAGACAA
ATTATGAAATAGACATCAAGCATTATTTTATTTTATTTTATTTTATTATAATAATTATGAATTTATATCTCTATG
GACAACTCTCTATTTAGATCTTTTATAAACTTTACCTAAGAAAGCAGTTAAAACATCTTTCTTTAAACCTCTAGA
TTCATCAATTTGATCAATTTGTTTTCTTAATTTAGCAACAATTGATTCTTCATAATCATGATAAATTTTTTCAAT
ACCCAATTGTTTAAATAAATCTTTACATTTTTGTTCTGATTCATCATCTTTTTTACCATAATTATCATCTAATAA
TTGACGTTGTTCAGGGGTAGCAATCAATAAAGCTTGATTAATAACCCAAGAACATTTATTATCTTTAATATCAGT
ACCGATTTTCCCAATTTGTTCTGGAGTACCAAAACAATCCAAATAATCATCTTGAATTTGGAAATATTCTCCCAA
GGGAATCAAAATGTCTCTAACTTGTTTTAAATCTTTTTCATCATTAATACCACTCATATACATTGCTAATGCCAC
GGGTAAATAAAATGAATAATAAGCAGTTTTGAAAATAACAATAAATGAATGTTTTCCAAAGAAAATTTATCTAA
ATCAACAATTTCTTCATCAGCAGTAATTAAATCTAATAATTGACCTAATTCAGTTTGGAAAGTGACTTCATGAAA
TAAATCTAATAAATCAACATAGTAAGGATCTTGACGGAAATGTTTTTTCAACAAGATATAAATGGCCCCTTCTAA
CATAAATGAATCATTAATAGCAATGTTGTTAACTCCTTCAACTAAATACCAACATGGTTGACCTCTTCTAGTTTT
AGATTGATCCATCATATCATCAGCAACTAAAAAAATATGCTTGTAATAATTCAATGGCCCAACCTAATAATGCAAC
TTTTTTATATTCAGTATCATTTAATTTATCACTAGTAGTATTATTCAAAATGGCAAATGTATCAACTACAGATAA
TCCTCGATTTAATTTACCTCCTGGAGTATTATAATTTAAACTTCTAACAAACCATTCAATGGCTTCTTGAGGCAT
ATTATAAGAAACTAAAATTTGTTTCAATTCTTCAACTAAATCTTCAAAAACATCAAGAAATCTTTCTCTAGCAGC
AAGTTTATCAGACATTGTGAAGTGAATGAGTTGGTTTTTGGTAATTGGTAATTGGTTGTGTTGTAAAGAAGGAAT
GGGTGGTTGTTATTAGGAGTAATTTTTTTTTTCATGATTTATAAACTTTCCCGAGGGGGGGGGGGGAAGAGGC
AGATCGGGTGAGATCGTGTGTCTGTATCAAATTTATGGTTGGTTGGTTGGCTGGAAAGTTCTTTTAAGCGCATAA
ACATAAAAAACATAAACATAAACCCAAAAATTGGACAGCGGCTGATACGCGTAAAGATTATATCAAATTAGATCT
TACACCATTGGAAGAAACTATTACCCTCTTTTAAAATATAAAACTTATTGGTTGTCAGTTTCTATGTTAATTATT
CAATTACTTCAAAAGGAGAAGAAGGAGGAGAAGAAGAAGAAGGAGGAGGAATCGAATTTTTGTGTATTTATTTA
TTTCACCATGTCGCTATTTATACATCAACTCTATTCTTTAATGTCTTCTACTACGTTTACTTTTACCAGGTCTTG
AAGTTGATTTACCTTTCATCTTTCTTGTTGAAAATCCACTAATATCAGCTCGATGAAGCAGCATCATTTTCTCTTT
TACCTCTTTTTTTACCACCAAATCCATATTTAGCATCTTTAGCCAATCTTTTAGAATTTGGTTTTCTTCTTTTAT
TATCACCACCACTACCACTACCACCATGGCCATATTTCTGGTTATTTTCAGTTGCTTCTTCTAAAGCAATTTGGA
AATCATCATCATTACTAATTTCATTAGCACCTCTTTTCTTTTTCAATGATTTAATTTTTTCTAAAGTTTCTTTCT
TTTGTTTAGCTCTTTCTTGTAAAGTAGCATGTTGAACTTGTTTACCAAATTTTTTCAATTGTCGTTGTCTTTTAG
```

```
CTTCTTCTGATGCCTTTTTATTGGCGGCTTCAGTTAATAATTTATTTTTCAATTTATCCATGTGTTCATCACTTT
TAACCATTTCAGCAAAATAATCCATGGGACGAGAGAATGGAATTTTCAATTTTAATAATGTTTTACGTGATTGTT
TAACAGCATCTAAACCTTGCTTATAAAATGCCAATTCTCTTTCGGTATCATCATAAATATCTTTGATTTCTGATT
CAGTTTTATCAGCACTAGTTATTGATTGATGCTCAATAAATGAATGTTTTGACCAAGGTAATTCAATACGTGCTA
ATGATTCTCTTAATGCTGCCATATTATTAATGGTTAATTTGGTATGAGGAACTATATCAGCATCGGAATCAACTT
CAACATCAGATAATGGAATATCATCTTCTGCTTCATCGTCATTTTCTACTTCGTCATCCTCTTCTTCATCGTCGT
CGTCATCATCCTCTTCCTCCTCATCATTGATATCACTTTCACTTTCACTAGCTGCTAATTTTTCCAAATCCAATT
CTTCTTCGTCATCATCATCATCTTCTTCTTCTTCCTCGTTATTTTCTGCTTCTTTTTCTTCCTCTTGTTGTT
TAGTTTGTAATTTCTTCAATCTTCTTTGTTCCTTTTTAGATAAAACTTCACTTTGATAATCATCATCATCTTTTT
TGGTATTTGATTTTTTCGATTTCTTGTTTGATTTCACTTTGGTGGTCACTGGGGCGGCTTCTATGATTTCTTTTT
CTTCTTCTACTGTTTTTTCTGTTACTGGGGTTTTCTTGGTTGGTTTTGATTTTGCCTTATCAATGGCATCTATTA
ATTGATGACTTTTCAATTGTTGTTTCAATATACCTCTAGCCATGGTTAGTTATTTAATTTAGAGTAATGAATGAT
ATATTAATGAGATGGAGGAGGAGGAGGAGAGAAATTTTTATGATTTTTTTTTTTCCTCTATGAGTGAAAATTAT
TGCGATGAGGAAAAACTTAACTACTATTTTTTCTTAATAGTGTTTGTTTTGTTAGGATTTTCCACTTCACTAAT
GATAAACAAGCCAACTAGATTGCAAAAAGTAGTCAAATATCTAAATGCTAATTTCATTTTATATATATATATAT
ATATATATTTAATACTAATACAACATAATAATGTCCTTAAATCCCTAACTCTGTGTCTATTTACCACCATTGATT
TTTAATCTCGTTTATAATCAATTTGATTAAGAAATCGTTTACCAGAACCATATTTCCACCATCGAGGTAAACAAC
TATATATATTAGTATCAATGGTTCGATTTATTTTATCTTCTGATTGTCGAGAAACACAAACACATCTTTTAGAAG
CCAAAACATCGTCAGCCAGAGGACATGCCAAATACGGTGCATGATAATATCCAATATCTTCAAAATGATGAATTG
AATCTTTATCAGCCAATAAACTCAATCCAATGGTATGAACTGGAGCATCCCCCCATCTTTCATAATAAAACCCAC
CCGTATGATCTAAATATTGGAAAAAAGTTTCATATGATTCATTACGGAAAAAATTCAAATTACCAATTTCAAAAT
TCGACCAAAAATGACAAAGATTATAATCAGTTGCTGAAGGAATTAAATCCATATAATGATTTAAAGAAATTTCTT
TACTTGTTAAAAATTCAATGGCATTATTTGGATGAAGTAATTCTGGATGTTTTTCATAAATGATTCTACTGTGG
GCCAAAGATTAGGAATAGTATTTTCATATTCAGTAATGGCAATAATAAATCCATAAATTTTATTATTAATTCGAA
GAAATTCAAATGGATCATATTGAAAATCACACATATATTCAACATTTGGTTCAACTCGAAAATACCAATCATAAT
TCAATAATTTTTTTTGTTTATAAAAAAACCCAGAATTAAAATGACACATATTACGATAAGATCTAACTCCACCAT
AAATAACATTAGTTTTAGAATTATCTAAATTTTCTTGTAATTTTGTTTCATTAATAAATATTGGTGGTTGCCAAT
CTTCGACAGGGATTAATTCATAAAAAGTTTCACCACTTGCCATTAATGTCGTTTTCTCCATAAATTCTTCAGTAA
ATGGTTCATCATTAAGGAAAACCCAAGGATATTTATAATCTCGATTGAATCGATCTTCTAATGATCGCATTGATT
CTAATGCTCCTTCTAATTCGATGTTTCTCACTAACATTACCATCGTGGCATTTTCTTTCCCTATCTGTTTCCTAT
TCTCTGGTGGATAAATTTTGTCTAAATATTGATTACTAGCTAATTTAGGTTGATCTTTCGCTAGTGGATTATATC
GTTGATATGGTGGTTCGCTGAACTTTAACTCAGAAAAATAGTTCAAAACAAAGTAGTAGTAAATAGATAGTATAA
CACCACTTATAAATGCAATCGAATAGCTAGTCATTGTTGGAGATCTGGGGGGATGGTAATAGTCCAAAGTGAAT
GTAATCTGTTAGATGTTAAAAATGAAACATAGAACAACAATAAACAAACAATTAACAGTAGTAGAAAAAAACAAA
GGGGGCGAAAAAAAAAAAAAGAATTAGCTTGTCGATGATTATGTAATATACGTACCGATCTGAGTCCCTAAATG
CGAACCAAAATCTCATAGTGACCAAGCACGTGATATGCAACAGTTGCTAGCATATTTCATTAGAACAACGCCGAT
GGTAACTCCAATAAGATTTTAATCGATGTGTTGAATTTGAGTGATTGAAAGTGGTAACAGAGAAGTCCTCCAAAA
CATGTATAGTAATTTAGAAGTTAGCGTTGAATTTTTAGTTTTTTGGTACTAAAATTTGTTGCAAAAATTTGATT
CAAAAATATATTTATTATTGATTATGACATCTTGTTCTCATGGAATTAAAAATACACAATCACCAATCATAATAT
ATAAACTACGGATATCAGTGATATAGTAATTTGCTTTAAGGCAATAAGTATAATGCCATATGTTTCAGATATGAC
TCTCTGAATCATTTTCAAAAGAACAAAATGAATTAGACTAACAGCTCGGCAAAAGCCTTTTCCAATCTTACTTCA
ATCTCCAATCAAAGATAAAAGACTAAAGAGTTAATCGTTAACTGGAAGTCCAGTCTTGCTTAGTTTGTCTTGTGT
TGCAAAACCTATACTAACAAAGCCAGAGAGGCAAGACTATCCCTATAAAGAGCCCCAAATAGCTTTGCAATTACA
TTCAAATTAACCAGTATCTGTTTCTTTGATTCAAAATTCTTGGACACTTTCAACATTGATATCGAATAATTGACA
CTTGATTAACATTAGCAACAAATACTTGACTAAAGAAGATCTAAAACTAATTGTTTGTTTGTTTGTGTGGTAGTG
CATATAACTCAATTATTCCAATTCTACCCAATAATATTAAAGCAAATCCAATTACGCAAAATTTTTTTTTTTTTT
TCCTGCTTTACCCAAATTCCAATATTCTTTTAATAAACTCCTAATAAAAAACATCTTGGGTTTTCTCTCTCTCTC
TCTCTCTCCAATAAGCATACAATTAATTTTTTTTTTAGAAAAATTTCCCAATTGTGAAACCCAATCAATTAAAAC
CCATAAAAAAAAATATAGACAACATTTTCCATCATCATCATCACCATCATCATCTTATCATTGTTCAATAGTAAA
CTTTAATTTCAACTTTCTTCCTCCATTTAACACTTCACAATATACTTCACTACCTTTCAATATATTTATAGATTA
CAATTGATAAACACACCTAACAAACAAATCATAAACTATGCTTAGCAATTTTAAAATAAAACCACGCACATTACT
ACGTGGATTAGCCACTGCTGCTGCTGACCCAGCTGCCAATCCTAATAGAGTACATGGTGGATTAAAAGATCAAGA
TCGTATATTTCAAAATGTTTATGGAACTTATGGTCATGATTTGAAATCTGCTCAAAAAATGGGTGATTGGTATAA
AACTAAAGAAATTATATTAAAAGGAGATAAATGGATTATTGATGAGATGAAAAAATCCGGATTAAGAGGTCGCGG
AGGTGCTGGTTTCCCCTCACGTTTAAAATGGCAATTTATGAATCCGCCAGGTTGGGAAAAAAATAGTGGACCAAG
AAATTTGGCGGTTAATGCTGATGAAGGGGAACCAGGTACT
```

YJL166W_homolog_1 93aa PathoSeq: 1..93(SEQ ID NO 656)
GAPHPHTYMGWWGSLGSPKQKYITQYTISPYAAKPLKGAAYNAVFNTFRRTKNQFLYVAIPFVVVWSIWTRARDY
NEYLYTKEGREELERVNV .

YPL271W_homolog 7123bp PathoSeq: 1..7123(SEQ ID NO 657)
ACACCTCGATGCACCTAATTTGAAAAAGAAAGAGATCAAACAGGAAAGATTTGAAGAATTTCAAAAACAAGAAAA
CAAAAAAACGTTTAAACAGAATCTTCGAACCATTGGAAGAATTATCAAATTGGGGAAACCAGATTGGAAATTGTT
TGTGTTAGCCATTGGATTTATATTATGTGCGGTTTTATACCCAACTACAGCCGTTAAATTAGTGGGGTCAGTATT
AGATTCATTTAACAATAACATAAAAGATAAAGATGGCGATTTAATTGTCTGGGGATATAAAGTTTCTACTGTATT
TGCAGTAATGATACCGTTTATGGCTGTTAGTGCCGTTTGCTTCTGGGCCAGAATTTGGGTATTGAAATTATTGGG
AGAGAGATTAGTAGCCAGATTGCGTGCTAGAGTGATGAAAAACTTATTGCGTCATGACCAAGAATTCTTTGATAA
TGATAAACACAAAGTTGGTGATTTGATCAGTAGATTATCGAGTGATGCATACATTGTCAGTCGATCAATCACATC
TAACCTACCTGATGGATTGAAAAACTTATTATTTGGATTGTTAAGTTCATATATGATGTATCTGATTAACCCGAT
GCTATTTGGAATGATGTTGTTAATCTCACCTCCAATAACAATTGGTTCAGTATTTTATGGTGAGAAAATCAGGAA
ATTATCGACCAATTTACAAAATGCCACTGCTGGGTTAACTAAAGTATCTGAAGAAACTTTGAATTCCATAAAATT
AATTAATGCATTTACTGGTGAGCAAAAGGAATTAAGAAAATATTCTACGCGTTTGAGAAGGGTAGTTGATGTTGC
AAAACAAGAAGCATTTGCTCAATCAAACTATTCAGTATCTATTTATTCATTGTACCACACTGGTTATTTGGCATG
TGTGGCCTTGGGAGTTTATTTGATGACAAAAGGTACAATGTCAGCTGGAGATGTGGTGGCATTCACCATGTATCT
GGAATTCTTCAATTCAGCATTATACAGTTTAACTACTACATATTTGGAATTAATGAAAGGTGCCGGTGCTGGTGT
TAAACTTTTTGCATTGATCGATTATAAAAACAAGGTCCCTGCTATCCAAGGAGAAAAGTGACTACATGGAGACC
TACTTCCGTCAAGGACGATATACAGTTTAATGATGTCACATTTAGTTATCCAACACGTCCGAATCATACGATATT
TGACCATTGTAATTTCAAGATTGTTGGAGGAACTAGTACTTGTATAGTTGCGCCAAGTGGTGCAGGAAAGTCAAC
AGTTGCTTCGTTATTGCTCAGGGCTTACGATATACAACTGGGTGAAATTTTAATTGGCGGCAAAAATATAAAAGA
TATTCAAGTGCGGGATTTGAGACGTTATATTATCGGTATTGTTCAACAAGAACCAGTGTTATTGTCAGGGACTAT
ATTGGAAAATATTGTTTATGGGTTGACTTCTTCTGAACAGGTTGACAATGCAGGATATTATCGATGTTTC
CAAACAAGCCAATTGTCATGATTTTATTGTTACTTTCCCTGATGGATATGATACCATAATTGGGAACAGAGGTGC
TTCATTATCAGGTGGTCAAAAGCAACGTATAGCTATTGCTAGAGCATTGATTAAAAGACCCAAAGTTTTGATTTT
GGATGAAGCAACTTCTGCTCTCGATTCAAAATCTGAAAGTTTGATAAATGAAACATTGAAAAATTTGACAAATGA
AGGGTCAATGACAATAATTTCTATTGCCCATCGATTATCAACAATTTCCAAATCGGAGTTTGTTGTTGTGCTAGG
TAAATATGGCCAAGTCGTTGAAACAGGGAAATTTGTTGAATTATTTAGTAATCCTGATTCAGAGTTGTCGAAATT
GTTAGATGAATCTGCAACTTCACAAGCAGCAGCGGATCGACAAGAGGAAGAAGAGGAATTACAACAAGAGAATCG
TCATAAAACTCAAGAAGATGAACGAGAGCATATTAATCGAGAGGCAGAAGAAATCGAAAATGAACAAATTAAATA
TAGTAAAGCCAAGAATCTAATTGAATCATTGCCACTGGATATGAAACAACAATTACTTACAGAAATCAATATTGA
AGAAAAACAGCTGATTAAATTGAGTTTATATCTTTCTCCTTGGCCCGCTTTATATCATTCATGTAAATAACTTG
AAAATGTACCTTCTTATTTTTTTTTAATTTAGATTAGAAATAGCAAAAAAATTTATAAATATATATTTATTCGT
ATTCTTAAAGACAATTCAATTGTATCATTTGTCATGACTGTATTCTATATCCATGAATTCTCTATCTTAATTAAT
ATTGGATTTGAAAGATCCTAAATGAAACATATAAAAATTCAGTTATAAGGAGGAGGCTGTGGGAAATTGTTTAAT
TATCAGTTGGTTTCAATGCAACTGGTTCACCTTGTTTACCATCTTTGAAAGTTATAACTTTGGCTTCAACAAATC
CTCTTTTTTCAGCAGCAGCTTTGAATTCTGGTTTTAAAGAGTTTCTTAAAGTTTGAGCAGCAATTGCTAAAGCTT
TGTTTAATGATACACCAGCTTGTTTGTATGCAGACATGACTAGTTGTTATTTATTGGTGAATAGATAATGAATAC
TGTGGGTTGTGAAAATGTAAAATATCTTCAATTGGATTGAAGTTTTTTTCTCCTTCTTTGATTCTTTGTTGAAAG
AAAAAGTTCGGATTACTTTTTTGAACATTGAGACACACCCAAGTTTTTTATTGGTTGAGAAGATTCATGCAACAT
GGTAGCTTTTGATTTTTTTGTCCCCTTTCACACGTCTTTCTATTATGAATCTAAATTTACTATTAATTACTATT
GGATATTACTATTTCTACAAGTCTATATATTTAACTAAGATTTATGTTTTTGTTTCTGGTTTTGGTTTTGATTAT
GAGAGGCATTACTCTTCTTACTGTTGACCCAATTGATAAAATCGAAAAACAAAGAAGGGTGCAATTTGCTTTCAG
ATTGTAAACACCATTGTTTTAATGAGTTGCAATAAATTTCAACAATTGCTTGCATATTTGATTCATCTAAATTCA
ACAAGTTTTTGGCAATGATAATACAACTTTGATTATAACTTTGTACAACTGATTGATTAGATGGTTTTGTAGTGT
TTGCCTTTGTTTGTAATTCCTCAATTAAATTGATTAATTGATGGTAATATTCCGATGGATCATCATTATAATATT
TCTTTAATTCTTCACTGTCAATTTTAGTTTTGGAGATTTTATTTCTCAATAATTTATGAGCTTTAACTCCCAAAT
TTTTATCTAATGTCAAATTCATCAAATTAATCAAAGGTTCAATGAATGCCAAATTAAAATGCAGATTACTGCGA
CTTTATTAAAAGTCTCTAATAAATCTAATACTCGATTCTTGAAGAAAATCATATTTCTTTAGCTTCTAAAACTT
CCAATTTACGTTTGTTACCAGTGGCCAAATTAGTTATTGTGTCCTGTCGTTGTTTGAAAATTTTCGATAATTGAT
CATCCATTGCCATCATTTGTTCATCGTCCATTGAATCAGATTCATAATCATCATCGGAAGAAAGGTCATCTAACT
CATCAAATTTAACTTCACCTGATTCCTTGGTGGGATTCCTAAAGCTTGAGCTAGTTTTAAATTAGTTTGTTTGT
CAATTTCAGTGATAGTATCTTCATTGTTGTCTGACTCACTGACATTGTCGCTGTCGTTGTCACTATCACTATCAA
TATCACTACTGCTATCATTCTCGTTGTTATCTTCGGCCTTCTTCATCCTCCTCGTCTTCTTCAT
CACCGTCACCTTCTTGGAATTCCCCATCTCCCTCAAAAAGTTTTTCTTGACCTTGTTTATTCTCTTTGGCTTCTA
ATACATCAAATAATAGTTTAAAACATGCTTCATTGACACGTAGTTTCCCGATCTCATCAACTTGACATAAAAAGT
TTTCCCAAACTAGAACTGACAATTTTTTAAATAAAGTAGATTTTCTTGAAATAAAACTCAATACAATTTCAGTCA
ACACTAAATTATCATCTACTTTGTTGTCATCTTCTTCGTTGTCATATTTGTTGGCGGTAGTGAATTGATTTTCAA ATACTAATTTCAATTCATTAATCACCTGGATAGTCTCTTCATCTTCCATATACAATTGGATCAAACACATTGAAA
ACATTAATTCAAAAATATACAATTTATCTGAAGATTTGGTGTTTAATTCAATGATGGTGGATAATAATTCTTCAG
TTTCTTGTTTAACTATAGATATTTCATCATCAAATTCAACAAGACATTTATTTTCTGGATCTCGAGATAATTTGT
TAATGATTCTATAACAAAATGTTGACCAAGTTTTATAATTTCTATGGGAAAGTTTTAAAGTGATAATTTCTGATA
ATATTGAATTGAATTTTTCTTTACAAATAGATTGTAAAAATTTTGATATTTTAATATCATTGGTGTCGAAAAATG
AATATTGAAGTAATTTTGTTAAAATAGATTCCAAAACAGTATCAGATAATTTGTGTTGATTATTGTTATTATGTT
TAATTAAGGAAACAATTTTATCCAAATACCATTTTAAAATATTATCATTAGAATTTTTATTATTGTTGCTAGTGT
CATCCAAAGTTGTTTGAGTTTGTAATTTGATAGTAAAATTCTCTAATAAAATATTGATATATTGATTAACATTTG
TTTTTATTTGTAAAATTTCATCAATGGTATGAGATTTACTAATTAGATCAAAATTCCAACATCCACCTTTAGATT
CATCTAATAAACACAGTAAAACAATAGGACCCAATTCAGGCTTGGTTTCTCGAATGGTTTTAACAAAAGTTTTTA
AAGTTTGTTGAGCAATCTTGTATAACATTCTCGTTGATGATGCATGTTGATTGATTAAACATCTCATAAAATTTG
GTGTAAATAAATATTGAACCAGTGAGGTTGTCTCTAAAGATGTGACAAATTTAGTAAAAATTTCAAACCCCCAAT
ATTTACGTTCATTAGATGATTTTCTGAAAATAAAGTTTCATCAACAACAACTTTCCAGAATTCTTTTAATGAAA
TATATTCTGGTTCTATTTTAGCACGTTTATTATTATGCTTTGGTGATGTGGTTTTCTTTCTCTTCTTTGAAGTGA
CCAACTGATCTTGCATTTCATCTTCAACATTTGAATCATCAGCAACTTGATTGAATTTGGCAACGATTAAATCCC
ACACAAATGGTAACCGAGAATTCCAACTACTCTTTTGTTGATTTTCTTCTTTTGGTCATCCCCTGTTTCTTCAT
CACTGATTACTTCGACATCTTTTAAAACTTTAGCCAACACTGGTAAATTTCCCTTATAGAATGGATCACCATTTT
TCCAATTTGCTTTCATATTTAGTTACATTTTGTGATAATTGGGCACTTTGAGGAACTGATAAATAAATTGCTAAAC
CTTCAGTTGACAAATTCAATCCCAGATTATTAACCATATTTAATATCTTGATATAAATTTTCTTACTATATTCAA
CATTACTATTATCTAATAATTTTATAAATTGTATCAAGGTGAAAATTCCAGTTTCTCTAATCCAATTTTTAAAAT
TACTCAATTCCATTAAAATTTCAACAAATTGTAACATATCTTCCGGTTCACTTTTCAAAATAATAATTTGAGAAT
TAATTAATACTTGTAAACCAAATAGCCTACCAAATAAAACTGCTCGTTGTTCTTTACCTTTCATTGAACTGGTTA
ATTTTGTAGTTTCAACAAGTAAATCTAAATATTTCCCAACAGTTAAAGTTCCCCGATTATTTAATTCATTGACAA
CTTCAGTTAATGCCATACTAAAACCAAATTTTGCTGATTGTCTAGTAGTTAAAATCCCTTTAAGTAATCTATTCA
ACGCATATGACCATTCTTCTTCATTATCTGCAGCAACTAATTCTGAAATTAACAGAGTGGCTGCATTCAAACGTT
CTTTGGGTAATTCAGAACCCAATTTAAAATAATGATCTCTCAGGACTGCCATATGGTCTATAAGGGTTAGTTTTC
TAGTGAGTTTCAGTTATTAAGGTTAGTTGGTGGTTGGTTGTCATTTTTTTTTGGTCCAATTTGAACGGTTTTTTT
TTTCTCTTACTTCTCGATGCCTCCAACAACCACGGACCCACCCATCGCAGAAAAAAGATTTTATGGTTATTACTT
CTATAGTTTTTTGACGCGTTTAACTCTTAAACATCGAATATTACATTATGTTGTCTACAAAATTCACTCTACGGT
CACATAAATCATCCGTAGCATATATCTATCAAGATCCAAGAACTCCTTTCAATCTTTTCACGGCAGATTCTTCTG
GGTTAATAATCAATTGGGATTTAACAATCCGTCGACCTAAAAAATCATGGCAAGCTCATACTGATACCATACTTA
CGATATCAACAATTCATAATCATTTATTAACCCATTCTCGAGATAATACCATTAAGATATGGGACGAGTCGTATA
GCTGTGTTTTGGAAATACCTTGCAATGCATTGAATTTTAGTAATATTTGTATTATATATGATTTATTAATTACTC
CTGCAAGTATCAATTCTAATAATTTGGATGTTTATAAAATCGATAAAGATTGGCAAATTACAAGATTAATATCGG
ATTTTGATGTTTATAAATTAGTTAATAAAGGTGAAATAATAGAAGAAATTGGATCTTCTGGAACCAGTCGTAATG
ATTTTGGTATAATAATGCAAATGAAAATCATCCACACTAACACCACTACCACCACCAGTGAGAACAATTCTGATT
ATATCATTTATGTGGGCTTTGAAAGTGGTGATATTGTAGGGCTACAGTTGATATTACCACGGGCAAGAATATTAT
CAACTACAGGAAACACTAATGATAAAACCCTTATTAATCAATCAGCGAAATTTATTCTTCAATATCATAATTCAA
CTCATGTCCCTAATCCAGTGATTTGTCTACTGAATCTAGATTCAGTGTTAGTATCTGGATCAACAACTAATAAAG
TGAATATTCATAGTGATCCCATTGAAATAATGAAAATGGATCATTCAGGAATTCAAGCAATTGTTTACTTTAA YPL271W_homolog_1 50aa PathoSeq: 1..50(SEQ ID NO 658)
MSAYKQAGVSLNKALAIAAQTLRNSLKPEFKAAAEKRGFVEAKVITFKDG YJR115W_homolog 81440bp PathoSeq: 1..81440(SEQ ID NO 659)
TTTGATATGATTAATGAGGTTTTAGGAATGGTAATTTCTGAAAGTTTTGGTGAAGTCGACATTATTGATAATTAT
AAAAAGGTTCTGATATGATTGAATATAATAAGATAAATGAATTGATTAAGATTAATTGAGCAAATAAAGAGTAAG
AAAAAGAATAATTGGTTGATTTGGGAAATAAGGAAAAGGAGTGGGGGAGGAGGAGGGAGTAAGAAAAACTTAAAT
ATATAAATGGTGCCGTATAGAAAAAATAAAAGGGAGGCGCATTCAAATTTTAAACACAGGTTAAATTGTTGCCGC
CAAGATATTGTCGCGGAGAGCACAGTCGGGGTGGTAGTAGTAGTAGTATTACTGGCGGTGGTGGTGGTGCGTGAC
CCTATTGTGTCGCAGTGGGAAATATTGGCATGATTAGTAATAAACTGCGGCTACTATGATTGGGTGGGTGTGTA
AATGACCTCAAGGACTAGTTAGTTAGCACCAAAGAAAAAAAAAAAATAATGACTGTGAATCAACTCAGCTTTAAAC
TCATTTCTTTTTTCGCAATTTCAGTGATCATTAATTGTTGAAATATATTTCATAATGTAAAGAACAACCAGGGTT
GAATTGTCCACCACAATAAGTACAAGTATAGCCACAATTGAGGTATTCTGTAACGGTTAATTCATTCACACAGTT
ACCACAAAGTACAGCCTTGGTTGTATTGTCATTTTTATCGAATCGGTCTGGTTCATGGTTAGTTGATTCTTGATG
GCATTTAAAGCATGGATAATAATTGTTACAACATTTGAATTTTATAGCAATGATATCTAGTTTAGTATGATAATG
AGTACATCTTGTGTGGTTGTCGACCAATTGTCCTATTAGGGATATGTTGGGAGATATTTTTGAATTTGAGATTC
AGATTTTGTCATTATGAAAGAAAAGGGAACAAACAAACAAACAATTGTGTGGATTTTAGTTCTGTTTTGGAGATT
GAAAAGTTGTTTGAAAGAAAGTTTCTGGGTTGTTGGTCAATCTTTAAGGGTAAGTAGAATTGCCAATGTTTCCAA
ACAATGATTTTTGTAATAAGAAAAGATTACTTAGTAATTGTTTAGTAGACTATTTTTTTCCGTTTGCCTTTTTTC

```
CGAAGTGTAGATGAGGAATGACTGTAAAGTATTATATTGAGCATCATCAAGTACTTATCTTCACACGTCTAACAA
ACAGATACAAGATAATAGGCATGTTTCATATTACGACTTTACAAGCTTTTTTTGTATTCCAATACAACAAAGATA
AAACTACTGAAACATAATTGACCATAAAAAATTATGATCTATTCCAAATTGGGTCAATTCTTTTTTAAAAAGTAG
CTGTTTACTGAAATTAACGTTCAGTATTTTTACAGCTCCACATAATTAGTAAAATGTGCAGAGTATATGGTGAAA
AACTCTTTTCTCTATGTCTGGCAAAGTTACTTTTCCACAAGCTTTTCCATAATGTTTTGTAAGAAAAAAGTTAAT
AAATTTAGTTAGTAGATACGAGTTTTTCTCATTAAAATGAAAAAAAAAAAGCGACTAAACACGTCTAGATCATAA
ATCAAAAAAAAAAGGGGCTCTTCATGAATTTACCCTTATTTCGGAAAGAGACAAAAACCTTGATCCTTTCTTACA
AAACTTTGGTAAAGTAAGTCATAACACAAATCTAGAACCTTGTCAACTTTGTTAACGTTTATAATTGACAAATAT
TAATAATTTATCCAACAATAATAATACGCGTCTCATCATGGGTTTTAAAAATACAAGAAAAATAATAATTTAAAA
TTCCTTTTAAGTATACCTCACAACAACCGCATATGAATTGAAATATGAAATTAATATTTTCCATTCGTAACTTCG
CTTGTCAAATTGAAAAAACTAGTAACAAAAAAAAAAAAGAAAGAATACTTATTGTCTATTTCGTTAAATTAATT
TTGATATGATAGATTGTGTCCATTTGGAATCCAGGACTAATTTAACAGAAATATCACAATAATTAATTGTGTAAT
AATAACAACAACATACTAAAATACAAGTTACTAAAAATTACTCAAGAATTTGCTCATCATTTAAGCATCACACAC
AAAACCTATTGAGACCAAATAAAAAAATAATTACTGTATTGAATAATCTGGGCACTACTACTACCTACTACTACT
AATACTATGAAATTAAGTGTTGCGCGTCAAATATATTTTGAAGTTGACATGTTGAATATCTATATTTCCTTTCTT
ACTAAAATATAGATATAGATATAATTATAATCACTGAATTGATCTAGTTATTGTTAAGTGATTTCAATTGTGGTT
TTGTAATGTAAAAAGTAGAGACATAAGTAAACATATCAGCATTATTATGTATACCCAATTCCATATTCCAACTAG
AAAACATATAAAGTTTATACCTCAGAAGGATACAAAAAAAAAAAAAAAAGATAATACGAATGTTTCTGATTCTAG
TAGTAATGTGTTTTAGTTTTAGTGATAAACTTTTTTTTTTCTTAATTAACTGCAAAGCTCAAATTAATAAATATA
TTTCTTATATATGAATTAGTTAAAGTCTTACTATTCTTTAGATATTTTGTTCAAAAACAATAAAACACAATCTAG
ATTCATAGTAGTTGAGTTTAATAGATTGAATAAGGCGTTTCTTGAAAATAAAGATAAAACCAAATGAAATTATGT
TACAATGAATCCCCTCCCCAAAAAAAAAAGTCAATCAATACTATATACAAAAGGTAATATAACACTATTATGATG
GGTCTAGAAAAGGGTCTTGGAAAGTGGGGCTAAAGTTTGTAATGATAAGTTGCAACTAGAATCAGCCCATCCCTC
TCTCTCCTTTTGTTACGAGCTTATTTTCAAATCAAGGTTTTAGTTTCTTTGTTTGAAATTAGTAACTTATTTTAA
TAGCAAGAACAGCTAAAAGTTTTACCATTTCTTTCTTTCTTTTTAACTAATTATCAATCTCATATTTAGTTGTTT
TGATTTATTGTTTTGCAAATAACAATTTAACTGATTGTGTGTAAGATCTAATCTGTTTTAAAACCTCGAGTAGT
AGTTGAAAAAAAGAAAAGAAATTACTAATCAACATTAGGCTTTGAATACAATATAGACACTAAATAAAACAACT
AACAAGCAAACCAAAATTTATCCTCCGCTTGTTATGATAAGTTTCAAGAAACTATATTGTCCTGTAATTATAAGG
CCATAAAGGAAATAGACAATGAAAGAAAGAAGGAAAGAAGGAAGACAGTTGTCCACATTGTAGAGTC
ATTTTCATTGTCATTTTCACCACCAGGGTCAATATTGAGCATTTATAATCCTCTCTTTCTTCGTCAAAGTAGTAT
CTTTTTCTCTCGCTTCGCTTATGTCATCTTGATTCAATAAATTAATCCGTAATTGACATTAACGTAATAATAGCC
GTAGCTGTATTATCACATAATGTAAGTAAAAAAAGACAAAGAGTTGTATGGTTATTCTTTTTATTTTTTGCGTC
TTGTGAGGACTTTGGAGATTTAGACTATTAAATTTTGTGTTTTAGGGAGGGCTTTTGATTCTAGGTCTACTTGCA
ATTGTTACACATGGTTTTTGTTTCGATTATTCCAAAGTATTGAGATATTTATGAAACGAAACATAAGAAGATATG
AAGATGAGTTTACATATACGTATACGCATATTTCAAAAAAACAAAAGATAACGTATTGATCATAACCACTTTAAC
TTTAATTTACGAGCAATATATAAATATATCTATAAATAGGTGCTAGAGATGGTGTGTTGAGGTATTTACATATTT
ATAGGGAAAACAAAAAGGGGGATCTACATTTGAGGCTAGTTAGACTTAGATTTAATCTTGAGAAATAAGTAACTC
TCCACCCCTCCACCACACCCCTATTCTATTCTGTCATTTCAACCCACACTTTGAAAAAGGATAATTATATTTCCT
AACATTCCTTTGCGTGTTTACCAAGAGAACAATGGAAAAGAATGATAACAAGACGAACGGCACGGAGAATGTGGA
AGAATAAAACCACCCTCCCTTTCAATATATAAATTTATAAAACAGAAAACAGAAATAAACTTATTGTATTCAAAA
AAAAACTACTTCATAACATTTGTTTTTATTTTAAAGTGATAATGAAACAGACTAAATTCAAACTTGAACTTAAAT
GGAGATTTCTTTTTTTTTCTTTTTTTTGGAATTTCTTTTGGTTATTGTTGTATTCATCCCTTTAATTGGGGATTG
ATAGTGAAAACCAAATTCCAATTCCAATTCCAATCACTTTTAAATATATTGTTGTTAAACAAAACAATATAGAAG
AGTAGAATAAAGGAAAGAGGTGGCTGTAATTCTGTTTGGTGATCATGATGATAAGGTGTAGAGAGTAGTAGTAGT
GCATAGGTACGATAAACTTGCATCGAAAATGTGGGTATGAGACTTTTTTATTTAGGAATTGAAACAATACCCAAT
ATCCCAAAGAAACTGGGAAAAATAATAAGAAAAGTTAACATTATACTACTACTACTACTAATAATAATAATAATT
ACTTACACACACACACATAGCAAGCACACATATACACAAACTTAAACCAATACAAAGCTTTTTTTATGGCTGATA
CAACACACATGCATGCAAAGCTTGGTCTCGGGAGACATACAGAAATGGAAGAAAAAGTCTATTTCCGAAATTGTT
TTTTTTTATATATATTTTCATCAAATCATACCGATCGCCCACCCATGCATGCATAAAACTATATTTTTAATGTGT
CTTGGTAGTTAAGGTGAATGAATGAGTGAATGTTAACCACGCGTCTTGTATATATGTTGTATTATTGTTTCGTTT
GTATGTTACGTATATGTTACGTGTGTGTGTATACTATTATTATTAATCACTATCATCATCTATACTTTTTTTT
TTTTAAACAATAAAATCAAAATGCTCTATTGTAGATGTTGTTTCTTATTGTTTAAAAAAGATGTTATAATTGT
TTTTTCTAAATTTTACTCAATACTATATTTCTTTCTTTTTTTTAAAAAAAAAAGAAAATAAATTTATAGATTA
AACAAAGACAAATTTAAGGAATGAGAAATTTTACACTAAATGCAATTAATAATGTGCATTATTCTTATTGTTGGT
GGAAGTGGTAGTGGTGATGGTGGATTGTTGATGATATATTATATGCATTAGAAAAAACGAACACAAACGTGTTGT
ATGCATAATTAATTGACTAATTAGTTAATATCAATTTCTTTTTTTTTAAACAATGTAAATCTTAACCTTTTTGT
TTAATTTATAGTTGTAGTTGTTATGGTTGTAGTAGTAGTTGATATTGATGTTGTTGAGTCAAAATTTAAATTTAG
ACTAGTTATTTTTTTAAGATATTGTCAATTTAACCCTTTGTTTTGGTATTTTAGTAGTTTAAAAAAAGAGAATAA
AATTTATTTCTTGTCTATATTGTATTTGTGATCCCTCTCTTAACTAAAAACTAACTAAACCCCCCCAATGCCATA
TATTAAATCTCTCATACTCACCCTTGTGTAGTGTAGTAAACTATATTATACTATATTATACTTGGTGTGTATATG
```

```
TGGGTGTGTGTCCCATAAAGGAAATGATATTAAACATCATAAAATACATATTATTTTATTTTTAACCTTTTGTGT
CATTTAACTTTTTTTTTTTTCCCACTTTCTTTTTTCCTTTTTCTTTTTCTTTTGGCTCTTCGTTCCCTTTTCCT
GTTAAAATTACACTAAAGAGCCAAAAGACTTTTTTTTTTTAATATAAATATCCACAAGAATTCCCTGCAAGATAT
CTCAACCACCTTCAACAAATTATTTTATTTTATTTAATTTTATTTAATTATTAACAATCCTTCTTTTTTATTACA
CTTGTTTTCCTTCATCTTTTGGTTTTAATATATATATATATATGAATAACAGCCCAACTCATATTCACTTGATTA
ATTATACAACTCAGTTCAACTCAATGTTACAATCTCCATTTACATATACTTCTAGAAAGAGAAGACACTCTAATG
TATCTTCATACCCAACTGTCACTACTACTTCCACCACTGCCACCACTTTCACTTCCACTTCCACTTCCACTTGCA
CTTCCACTACACATTCTTCATTGAATACCAACTTACCAACACCAACATCAGCAACAGCTCCAATACCAAGTCCCA
AACGACAACGCAAATCTAAAGCTGCTATGTCGGTATTAATTAATAAATTATCACAAATGCAATCAAAAATTGATC
TTTTACAAGATTGTGGATTAAAATGTGAATTACAACAATTGATAGAAGAAAGTGTACAAGAATTGAATCAAGAAC
CTAAATCAATACATATGAATATTCCTCAGAAATCATTTAATGAATTTATATTAAATACTCCCAAATCATCTACAC
CTTTAACATTATCTACACAATCAACATTAATAAAGTCATGTCGGGAGGAAGTTTTCCATACTATAGATGATGAAG
AACATAACAATCTTATAGAAAATTATCAAATATTTGAGACTCCTAAAGAGAAAATCATAAATTATGACAAGATAA
CTACTCCACCAAGAGCTCCAAGACAAGAATCATTATTACCTGGTTTGAATTTTCCAATATTTGATAAAGATGAAA
TTGAATCTGCTGGTTTAGGTTTTTGAAATAAAAAAGAATAATGAATTGATGTCATGTCATGTCTTGTCTTGTCT
TGTTTGCATTTGTCACGTTTTGTTTAATTGACTTAAACAAAATAACTTTCCCATTCCTCCCTTCCCCTCTCCCC
TCTCCCCTCTCCCCCCAACATACCATACCCTTATTTTTGATGATGATGATGATGATAATAATGAAGCTCACAGAG
TATATGAAGATTGACTTTTCATAATCCCAGAAAAAAAACTATTAAAACAAGAGACAAGTAATTAATGTTTGTATC
AATTTTTTTCTTCAACAAAAATTCAATTCAATTTAATTCTATACTTAATTTCGAGAGTTTTGATAACCCATAATA
ATAATAATGATAACAATCTACATTTTCTATTGTTTAAATGCTATTTTCATTTTAGTTTGATTTTGATTTCGATTC
TGTTTGTCTATGTATTCCTTTATAGATTTTTTTTAACTAATAAACAATCTTTTTTGTTTCTACTATATGAATTGC
TCTTCAAAGTCACTGCTATAGAGTTATGTGACAATTGGTAGTTTGAACAGTTTTTGAAAACGATAAGGTCGTATA
GCACAGTTACCTTACCCACCAATTTGATGATTCTAGTAATGTAGGACAAAGTAATAATCTGTAATATAGCCTAAA
AAAATTATAAGATATGTAGAAAGTGGAAAAACTTCTTTTGGTGTGATTTTGTAAACTTATATTAAAATATCTCTT
GGTTATTATTTTTGTTACCACCAAATCATGCTCTATTTTGTATCATGATATAAAATCTTTATGAACTATTGACAA
AAGCGCAATAACAGAGAATTCACCTTCTCTAGTGTTGATTCTTTCAAGATGTTATAGAATATAATTTGTTATTTG
TAAAAGTGTTGTTGGACCATTATTGATTAATTAACTCCGTTTTTTTCTTTTATTGATATATTAAGTATTCATTG
TCGTCGTATAGTCTACGATATAACTACAAATGCATTAGATCACCAACTAAACAATTGATTTCTTCGCCTCCTTTT
CCTCTTCCTCCCCTTAGAAACGCAAAACCTCGCCTTAAGGGAATAATTAACAACTAAATAATAAATCATGGCGTT
GTTGTTGTTGTTGTTGTTGATCTGGACAACCAATATCTTAATAATAAAGCAACGCGTCTCCTGTGTTTGTTGTTA
ACCCGAAAGTAAATTGAAATCATGTAATAATATAAATATTATACTTTTGTGGATCCCCCCCCACCAGGAACCAAT
TGGTTTTTTGAGTGAATTTCTGACGTGCGACATCCCCCACAAAATTGATTTGACGTCCAACAATCACACCCTCAC
TTTTCAATCAGGGTAGTACATGGTGTAGTCCCTTGATGGTCCCATACGCGTATCATTTATTTCTATTTTGTTGGT
CCCTATCTAATTTTTTGTTGGGAGAGGGGGTTGGTTGTGAGGCACTTTATTATTTTTCTTGGACGTGATTTTAGT
TTTCCTTTTTGAATTACATCAATAATTTTTTCTTAATAAAAATTATCATAAATAATAATTGATGGTCTAAATTGT
GATGGTAACCAACGAACATCTAAAGAAATTGTTAATTAATTGTTATTGTGGTTGTTGTTAAGAGAGAAAGAATGT
AAGTTTGAGTTAATTTTAGACGGTGCTTTTTCTTCTTGTTAAATTAGTGATAAATTAGTTTCTCATAATTCTCTT
TGTTCTGATAAAGTAGTAAATGATATTGTAACCTAATCTAACATTACTTAATTGATAGTGGGGTTCATTATAGTT
AATCCTTAGTGCATATTAACATAATTTGTACAATGATAATCTAAATTGATTTACTAATTTGATTTCGATTTTGAT
TTTGATTTAATTAATTTTTTCTTTATGAGGTGAGATGGTGACGTTGACAACTGGCTTTTTTTATAATTAAAATTC
CTTACACACACATCATAATTCATTCAATTTAACTCTTTTTGGAAATATCAACCAATTTAAATAAAGCATCAACGA
CTACTGTCTTGCCTTAAGTTCAAAAAAATACCACGAATCTAACCACCCAACAAAGACCAAATCGGATTTGATAAA
TCTTCCCAAAATTCCCAACACGTTATTATTATTATTCCAAACCATTGTTTGTGGATCAATTGTTTTTTAGTTTAA
TCTGGATTGTATTGTGGATCGAAAGGGGGAGGGTTTGGGAATTGGCCATAATCTATAAGAATAATTCCAACAAAA
ATTTTAATGTAAATATTAACAAGTAGTCATGTAATACTTCTGTGGTTAAATAATTCTACATACAAAACATGTGGA
AAGGGAAGGAGGGGGGGTGGCAGGTGATATTGTCCCGTGATAACATAAGATTTCTGAATCTATCTTGTGCTAAT
TGACCAAAAATGTTATTGTTTGACTATTGATCTCTGGATCAATATCCTCTAATTTTTTTCGAAACTAAAAGTAC
GTATATTTACATCACTCATTTCCCAATACAGTATAAATTGTATTAGTCTATTCTCTCTTACTCACGTTTGATTTA
TATTTTCACTGAATTATAAATGTGGGGTTATAAGGGGGCAGGATCAAAACATCTTATTATCCGCCTCTCCCCTTT
TATTTCTTTTTAAAGCCTCCTAGTGATATTATGTTAACATTGATTACACTTAAGAAAGAGTGATAGATCTAACAC
AACTAAGATAAAACTAGTAATGTGGTAATTGATTGAAGTTTTGGGAAGAACATACATTTGGTCTTCATTATACGA
GAGAGAAAAGATAAGCAACTACTCTTAAAATGAATCTAAAATGAAAGGCTGCTAATGGGTTAAAGAGCCAATTG
CCGGTCAAACATAATACATTCTTACCTTTTCAATAAATCAACACCTAAGAATTCAACAATTGATTTACCAGCAGC
AACCACTTCTTCGTCAAAATACCTCCGACCAGCTATTTGTAAAGCAATTGGGGCACCACAACATTCATCAGGTTT
ATAACTATCATTTTCCAATTCTTCCATTCCACTTCTATATTCATATTGTAAATCAGATTCATTCCAACGATCAAT
TTCAGGATCTTGAAATAATCCTGTTTGGAAAACCAATGCTGGGAAATCTAATAAATTATAAATCAAAGTATAAGA
TTCATTATAAACTTTTTCTCTATGTGGAGCAACATTATTATAAGCAGGTCCAAGAATCACATCAACTTTGTTTTC
CACCATAAAATCACTATATTCTTCTCTTAATGTATCTCTTAATCTATTCAATTCTCGATTCTCAGCTACAGTATA
ATGTTTGGCTCCATCACCAAGATTCAAATACCATTTCGTCAACTTTTTTAATGGTTCCCCTGATTGAGAAAATAA
TTGACACATCAGATGATTCCCATCAGCATTTGATAACTTAGTAGCACAATCATAAGCTAATTTAGAATTCGTTAA
```

```
TGGATGTGTTGTTGTCGTTAATTCAATGATTTTGGCACCTTCATTTTGCAATTTTTCAACAACAATATCCAATGC
TCGTCTAATTGGTGGGGATACCCTAACTACACCATCATCTCTAACAACAGCAATAGTCAATTGATTGATTTTTGG
TGGGCTCATATCACGCCAAGGAATTGGTAAACACCACGGATCAAAATTCCAGGGTTTTCCATCATTTATATAACT
TTTCATCCATAGTTCCAAATCATCAATACTTCTAGCAAGTGGTCCTATTACACTTGGTACTGACTCTTGACCATC
TGCCCCACCAGCTATTCCTCTAGCAGAGATTCTTCTTGTGCTTGGACGTAATCCATGACAACCAGAAATGCTGC
TGGAGATCTAATTGATCCGCCAATATCACTACCAACTCCCAAAACACTGCCACCAAATGAAACAACTGCTCCTTC
GCCAGAGGAAGATCCTCCACTTGATAATAATAAATTATATGGGTTTTTAGTAAATCCAGTTATATTATTCCCCGA
ATCCAAATGTAAAAGCGCTTGTGGTTCATTGGTACGCATGTAGAATACTGCTCCTAACTGAGATAATATTTGAGT
AGTGATAGCATCTTTTTTTGGTATATTATCAATCATGGCAACGTATCCACCATGAGCAATTTTACCTCTTATACA
AATATGTTCTTTAAGTGTAATGGGAATACCATGTAAAGGCCCAACTAGTTTATCATTTTTTGTAAATATTCATC
TCTTTCCTGGGCTTGTTTTAGTCCTTCTTCAATGAAAATATCTACAGCACAATTGGTGAATTGGTGGGCAATGAT
TGCTCTCTTGGCAAATGCTTTAAATACTTCAACAGCAGTATACTCTTTGGATGCCATTTTTTTCACAAGTAACGT
ACCCGGAGTATCGGTTATCTCAAATTCCTTCTCCGATAGCAACTTTTGTGAATATAAATAATCGACGGCATTGAA
TTGATTGTTGGTTAAAATATCCAATGATTGTGGTAATTCAATCAACAATTTTTGTGGTGTAGAATTGGCCAAGTT
AAGCCGGTATTGTTCAACCTTGGGTAACCAGTACTTGGTGTACTTTTCAGAATCCTCATAATTATCAAGAGGATC
TTTTGTTAATAATGAATAAAAAGTGAGTCAGACATGAGCCAGGAGGAAAAGTATTAAATGGAGTGAATTACTGA
TTTACATTATTGTGGGGAGCAGAAGTACAGCAATAAATATAGTTGAAATATTATGGAGTTGAACATTCCTTGTT
GGTACGCAAATAACTTCCATATTTGGATTTCAAACCGGTTTTCTTATCGTTGAAAAGCTAAAAAAATTAATTGC
GGAACTGTTGAACCGCTTGGTTGGTTGGTTGTCTCTGGGTTAACAGTTATCATAACCTTAACTTATTTTGCAATA
TTCATTATTTCCAAAACAGCTGAACTTGATATATATGTATTATTGCTCAAACCATAACCATAACTAAAGAAATAA
TAGAAAAATCTGGTCATCACAAAGATATATGTCTTCCTTTGATAAAAGCAGGAACGAGATCAAAATAATTCAGCA
GTGAAACGATCACACAATGAAGCAAAGGGAAAAAAAAAAAACAATAAAAATTTTTTTTTTCTCTTAAGCACTTGGA
AGTGATTTCATTATATCAACAAGCCCCCGACGTCCCCCAGAGAAATGGATTTTGAAACAAGAGAAGACAATGATG
GGGTTAGACTCTCGTGGACTTCTTTACCCAAATCCAAATTACAACATCAAAGAAATGTTATCCCTATGGGTGCAT
TATATACTCCTTTAAACAACAAAACATCAATCTCCGTTCTAGACCAAAATTGTATTATTAGTTGTCGAACATGTC
GAGCAGTATTAAATCCTTATTCACCTATAAATAACTCACTTTGGACATGTCAAATATGTAATTCATCTAATCAAC
TCCCAGCAATGGTTGACTCTGAAGGTCAGCCATGTTACCCTCCCAATCTCAATCCAGAATTAACAACAGTAGAGT
ATAAAACTGGTAGATCAAGTGCTTTACCTCCAATATTTTTTTATGTTGTCGATACCATATTTGAAAATGATGATA
TTGAAAGTGCTTTCCAACAACTTAAAGAAAGTTTAACAGTGTCTTTGAGTCTTTTACCAGAAGATGCATTAGTTG
GGTTCATCTCGTTTGGTAAACATGTGAGAATACATGATTTGGGTAGCAATGACAATTTAAGTTACACATTTAACG
GGAACAAACAGTACACATTGGAACAACTTCAATCTTCCCTTGGATTAATGAGTTCCGGATTGAGCACTGCTGGGT
TAAAACAAGCTAAAGATAATAATGGGTATGATCAATTGATTGGTAATATAGGTAAAAGATTCTTACAGCCAGTAA
ATATTGCCGAATATCAATTGACAAGAATTATAGAAACCTTGGTACCGGATAGATTTCCTCATAATGAATATAGTG
AACGTCCAGAAAGAGCCACTGGTGCAGCAATAAATGTTGCTTCGTTATTGCTAAAAACCATTTTAAATAATCTGC
ATCATTTGACTGGTGGTCATTTAATGGTGTTTATCAGTGGTGTATGTACTTTTGGACCAGGCAAAATTGTTGATA
AATTGTTAAAAGAACCACTCAGATCCCATCATGACATTATAAAAGCGCAAACAACTACCATACAAACTCCATCGA
CATCTCATGTTGCCAAAAGTGATATTAATTTATTCAAACAAGCAAAAAAATTTTATGAAGGAATAACTAAAACTC
TTGTTACGTTGGGGCTTAGTTGTGATTTTTTCATTGGAAGTTATGATCAAGTGGGACTTTATGAAATGGATGAAG
TATGCTATAAAACAGGTGGTAGTGTTGTTTAAGTGATTCTTTTAGTACTGCCATTTTCAAACAAAGTTTTATAA
GATTTTTCAAAAAGCAAGAAGAAGACGAACAAGATGGAGAAAATTCTGAATATTTGGATATGGGGTTCAATGCCA
CTTTAGAAGTTAAGACTGGAGTTGATTTGAAAATTGAAGGGCTTATTGGGAATGCAACATCGTTACCTTTTAATA
AAACTGTTCCTGCTAATGAAAGAATGATAAGTACCAATATTGTTGGAGAGGGGAAAACCAACAGTTGGAAATTGT
GCAATGCCAATCCACAATCAACTTATGCATTATATTTTGAGAAACTAGATAGTGTTGCTGCTGCTACAACAATAC
AGTTTCTTTTCCATTATCAACATCCATCAGGTGAGATGAGATTACGTGTCACGACAATTCCTGTAAATATTATTG
CTGATTCCGATAACATCAACTTGGAATTAGGGTTTGATCAAGAAACTGCACTAGTTTTGGTTGCCCGTGACTCAA
TAAATAAGTTACAACCAGGAAATACAAAAGTGGCAACAACAGCTAGTATTGTCAAACAATTGGACAATACATTGA
TTGATTTTTGTACTCGTTTTGCAGTTTATACTGCTGGTCAGATTGAATCTTTTAGATTGGCACAGACATTTTCTT
TATTCCCCCAATTTCTTTACCACTTAAGACGATCCACCATTTATAAATGTTTTCAACAGCTCACCTGATGAAACCA
GTTATGTTAGACATGTGTTTATGCACGAAGACACCGCAAACTCATTATTAATGATCAACCAACATTATTGTCCT
ATGATGTAAATACATGGGGGTCGTTAGTTGATGAAACCACTGGTGAAACAATAAATGAACCTGAACCAGTATTAT
TGGACTCATTGAGTTTAGGACGATCCAAAATATTGTTGTTGGATACATTTTTCCAAATTTTAATTTATCATGGAG
CTCAGGTTGCTGAATGGAGAAAAGCTGGATATCATGAACAAGAGGAATATCAATATTTCAAAGAATTCTTGGAAG
CTCCGAAAAGGGAAGCAATGATGCTATTAATGGATAGATTCCCCTTGCCTAGATTCATTGATTGTGATGAAGGTG
GATCTCAGGCAAGATTTTTAATGGCCAAGTTGAACCCTAGTACAAGCTATGCTACAAATGTCAATCATCTTTATG
GTATTGGAGACCGAAGTGACGTTTTCACCGATGATACCAACTTACAACTGTTTATGGATCATATACAAAGAGTAG
TTACAGCTAAAAAATAGACAATTGCATTTATATAATAATAACAAAATAGCATTTATTTACCTTTGGCTCTAGCAG
CCACAATTGCTCTTTTTAAGAACTGACTTCTAGCTGGTTGTTGTCCTTGTGAGTCTTGATCTATATCCATGATAG
AATCATCTGCTGAACGAAGTTGTTCTACTTCTTCTGCCTTTTTTAATGTGAATTTTGTGTTATTATTGCAAGTCA
AATGTTCCTTAACCTTGCCTATAAATTGACCATTTTCATCAAATATTAGTTCAGTACCTTGTAATTGATTCCAAT
```

```
CAGTCTGATAAATTTTCCCATCTATAAGTGCTGATGGATCAATGACTCCTGAATTGTGAGTATGACTATTAAATC
CATTTTTCGACGCTGATAACGACGACGACGACGAGCCTTGAGCAGATATAGTATTGTTCGATATTTTTACTAATG
GATGATCTTCTTTTAAATCAGTAAATTGGAGTTGTGCTGAAGGCTTGATAATATTGTTTTTGAATTTTGGAGCTT
GACCTGTCCTTGATGGTGGTTCTTCTTCATTGTCGATTTTATTCGAAATTGAAGGTATATCGATGGTTACATAAA
ATGTCTAAAAACACATGTGTTAGTATTTCATTTTGAACTATTTTTATTTTTAAACAAAAAAGTGAATCAAGAAAT
TCAAAACGTTTGTATCTCTATATTTTCTAAGTTTGTGTCTATTTAATATCTCTTTCAAGTTTTACGTACTTCAAA
TTCATCTTCATTCCCATCTATTTCTGCCCCAGTGGCAGATTCAGTGATGGGACCATCGGATTTGGTTTGTTCATT
TTTCTTCAATGCTTTTGCTTCTGCTTCTGCTGCTGCCTTTCTTTGCGCTATATCTTCAGCTGACCCGGCTTCAAC
ACCACGACGGAAATCCCAGTTCATTTCTTCACCCTGTGTCAAGAATTCACAATTACCATTCATGACAATTTTCCA
TTGAATAGTATGATTGGTTTTATCTTCGCCATCTCTAACAAATTTGGATAATGAACATGCACCAGCACGTAACAC
AGTTTGATTATCATCTATAACATCAGTAACTGATTTTAACTGTAATAAAGCTGATCCTAAAGCAATTTTCGTTGC
TGCATGTGTAACTATCAACACATTTTTAATTTCGGGGAATTTCTTTTCAAATTCAGGAATAAACTTTTTCCAAAA
CAATTTGGCACGATCGTAGATTTCATCATAATCTTCTCCTTCAATATTAGGTATAACATTTAAGTTATCTCTTGG
CCAAGTATCTTCATCGATCAATAATTTATCGAAAAATGTTCTCAATTGTGTGTAATCACCGGGAACTGGTTTGGT
ATCTCTATTTTTACGAAACCATTCACCAACTCCTCTTTCTAAAGCAATCTTCAAGTCCAACATTTCGGCAATGGG
TCTCGACGTTTCTATACAACGATAAAAAGGTGAAGCAATAATAAATTCAGGCTTTTCATGTGTAGGTAATGATGT
AAGATAGGCAGCTAACTGTTGGGCTTGTTCAACACCATGTGGTGCTAAAGCCGGGTCACTGTCAATACCAGTAGG
ATTTGGTGGGTGTGGTGGTGGTAACCAATTGGATCTATAACCGTGTCTTGCGATATAAATAGTTTCAATCGTCAT
ATTTGTGAGTAGAAAGGTAATCTATTGATATGTATATAAAAGAATAAAGCAATCTTGTAACAAACAACTAGTAGT
AAAGAAGAAGAAGAAAAAAATAGAACGATGAGAGTTTGATTGATGTTTGAGTGAGGAATTGGTCTTCTTTAT
TTATGTTTCATTTTTCTGTTGTTGTTGTTGTTGTGAATTTGTCATAATAATTTTGCGACTCACCAGTTACGCAAT
GTGTGATTCAACTATCATTAACATCACGATACTGTCAAGTTGACAACAATTACTCGAGACAAGCTTGTCTTTCAA
TGCTAATTATAACACTTTGGTATATACTAAAAAGTTTACTGTACATTATTTGAGTCTTCTTTCGAATACTCTTTT
TTTCATTTATCTTATATCCACTTTTGTTCTCTAACTAGCCTAACCTAAACGTATTTAGATCAACATTTCTAATG
GATTTTCGACAATTCTCTTCAATTCTTTCATCCATTCACCACCAAGGGCACCATCAATAACTCTGTGATCAAAAG
TACCAGTAATAGTGATAACATCATCAAACACAAATCCTTGTTCGTTAACTTCACTTGGAACAGCTTTCTTTTCGG
TAGTACCAATGGCAAGGATGGCAGATTGTGGTGGGTTGATAATAGATGTGAAAGCAGTAACAGCATGGTTCATAC
CCAAGTTGGAAATACAGATGGTACCACCTTGGAATTCTTCTGGAAGTAATTTACCAACCTTGGCTCTCTTACCCA
AATCTTTGACTTGGTTAGAAATTTCAGCCAATCCTTTAGATTCAGCATTAGTGACAATTGGAGTGATCAATCCAG
TTGGGGTGGCAACAGCGACAGAAACATCAACATTCTTGTATTGTCTGATAACACCTTGTTCACCTAACCAAGCAG
CATTTACTTCTGGAATTCTGACACAGGTCTTAGCAATAGCCTTGATTAATAAATCGTTGATAGACAACTTGTATC
TTTCTTCAGCAGTGGCATTCAATGAAGCACGTAATTTCAATAATTTAGACACGGAAATTTGAGATTGAATAATGT
ATGATGGGGATTGTTGAGTAGATTGTAATAATCTGGAAGCAATTGTCTTTCTCATAGAAGTGATTGGGATATCTT
CGTAGGAAGCAGTAGCACTTGGAGCAGCACCGGCGGTGGCCGGCGGCGGCGACTGGAGCAGCAGCAGCAGCAGCTT
GTGGTTCAACACCTTCGAGATCTTTGGCAACAATTCTACCATTTGGACCAGAACCTTTAATACCTTTCAAGGAAA
TACCTTTTTCTAAAGCAATAGTTTTAGCAAATGGTGATGCAATTATTCTGTCGGTTGGGGCTTTTTTAGAAGATG
GGGATGGAGTAGAAGCTGGAGCTGAAGTGGAGGTAGAAGCCTTTGGTTCTTCTTTCTTTGGTGCTTCTTCTTCAG
CAGCAGGTGCTGGTTTTGGTGCTTCTCCGGCATCAGCAGCAGTGAAATTTTCAAATGCTGCAACTTCACCGGCAT
CTTCAACATAAACAGCAATTGGTTGTCCAACTGGAACGTCTTTAGCACCAGCATCCAATAAAATCTTGGCCAAAT
AACCTTCTTCTTGAAATTCAAAATCCATTGATGCTTTATCGGTTTCAATTTCGGCGATTGCTTCACCAGGTGTTA
ACTCATCGCCAACTTTTTTGGCCCAAGATTGAATGTTACCTTGAGTCATGGTTGGAGATAATGCTGGCATATTGA
TAACAGTATGTGGTGGGAATTTACCTGAAGAATATAATCTTGCCAATGCTAAGAATGATGAAGTGGTGGCAGTAG
AACTTCTTGGAGCAATGCTACGAAGAGCAATTGCTGATCTCGAAACGGCAAATAAAGCAGACATTATAATTCAAT
GAATCTGAATAGGTTGATAGTAGTGAATAATTATAAAGTTGTTCTATTCAAGGGAAAGAAAAAGAAAAGAAAGAAA
AAAATGGCTACTGATTTAAGTTCTTTTTGTTTAATCTGCGATGTGTGTGTCTCTATGATGAGAAAACAGTTTGTT
TCTTTGTTTGTTTGCCTGTCTAAGTTGTCTTTTTTTTCCGAGTTTTTTAATTTTTTACTTCACCAATTTGTCGT
TGTTTTGCGGTGTTCAATGGATTGATCTTGTCCGCTGCGAGAAACAATTGCCCATACACTTCGGACTTTTATTTC
CGTGTATACAAAATATATATTATATTATATTATATTATATTATTGTTACATATGTAGAACACTATTTCTA
GTACTCTCTATAATAAGTTTACATTACTACTACTACAAAAGTAGTTCCTTTTAAGCTTACTATTATCTTTCTTTT
TATCTATCATAGCAAACACATCTTGATAGCCTTTTCTACCCCCTTACCTTGATCTTCATAAACAACTTCTGCGG
CATTGTTTTTAACCAAACTATCTTTTGCCGTTTGCCATGAAAATCTAATAAAGCCATAGCACCAACCAAACACTG
GATCAACGTTGGAATTGAGCCATTTGCTGGTGTTAGGGTCACTGGGATAACCTGAACCCAATTTTTGGCCTTGTA
AAAGTGGCAAGTTTTCATTATAGAACTTTATGTTTGTATCTCTTGTGACTTTAGCAACAACAGAGGCTGTACTCA
CTATTGGGTAAATGCTATCGGCTTTTTTCGTTACTGTGACATCAATTTCTGGGAAGAATCTTTTTAGTTTGGCTT
GATACGTTACTGGCGGACCCACAGTATCGACAAATATTTTCGATATCTTTTACACCTTTAGCTAATACTTGTTTGA
TCAAGTTAATAGTAGTATCATGTGCTTGTTCATTCAAATTGTAAGCTCCTTTACCATTTACTGACTGTAACATAC
CACTAGAAATGTCTCTAGCGGTCATCGTTGTGGTAGCCCATCCAATGTGTTTATGCAATTCATGATCTGGATCCT
CAATTTGCTTGAATAATTCTTCTCTTTTCACATCTGTCAATACTTTGGAATCAGCAAAGCCATATTCTTTTTGAA
GTTTGGACAGAAATGATTCTAGAGAATATGCAATCCCATACACCATGGGACCCAATACTGGTCCTCTCCCAGCTT
```

```
CGTCAACACCAAGTACAATTGGTTCAGTCTTGTTTTGTAGAATACTTTGAGGAATTTCTGAATGATAAGTAGAAC
TTGCAAATTTGAATGGATCTTCAATATTGGTCACGGATGGTGGTAGCCAATCTAATGAAATTGCAAGTTTGGATC
TCTTATTTGTATCACTTTCTGTTGCTTCTACTGACTCTGTTGTTGTTGGGGTATCTTCAGTAACTTCATCAACCT
TTCTCTTGAGGGATGCATCAAGTAATACTGTATCTGGAGATTCCAATGCTATTGCAGATGCCATGTTATCAAACT
TTTCTATATAACTTCCACAAAAAAAGAACTAGGAACAAGATCTGATAAATCTATTTGAAAAAAAAGTTTTTGTG
GGAGAAAGGAATGAGGAATCAAAGTAAACAAACAAGCTGGAGATGTCGCGCGAAAACATTCAACACGCGTCGGCC
CAAGTAATGGCTGAACAGAGAAGTACATTAAAATGTTTCATTGAAGAACATTTCAAAAGCTGATTTCTATGTATT
TTTCTGTTTTTATTAAATGGTATTATGTTTATAAGTGGATGAGGAGGCTATGGTTTTGTTAATTAGGCGCTTTTT
AAACTATTACTTGATTGTCTCATTTTTTGACAAAATTTGTTGGAAAACTGCAACCAAATTTTCATGCCAAACAAC
TTTAGTCAGAAATTTCTATCAACTGCCTTATAACTTGTGATTAACACCACAGTATTGTACATTTCTAGAAGCTAT
AGTATCAAAAAGCGGAACTTACTAGCACTACATACAACTGGTGGTGATGATCACACAAATAGATTGACAAAGCTC
GTCATTGAATGGAATGCCTAACATTGACTTCTCGTCTAAACAATAGATGCGGCACAAAATTATTAATAGAATAAA
CAAACCGAGAACTCAAATAATAATAATAGTGAAACTGCAAAGAGAAAACTTCATTGTAACAGTATACTTTCCTTA
AAACATTAAAACACATTTGAAACATTTCATATTTTTCATGGCTGATTAAGATTGCGTGAATAAAATCATTGGTGT
TGTGACAGATTTTTTTCTTAGGGTGGTGCTAATTTATCTTTACTCTATCGCAGATTACGAACACTTCCCCCCGTC
TTCCCAGTTCAGTTCAATCAAGCTATATATCACTTTTGTGTTTAGTTAGTTTCAAAGAGTATAAGATGTTTTAAA
TTGAAAGATCATAGGGAAGGCCATTTTTTTTTATCGTTGTCTGTTTTAGTTTATTAAGTAAGATTTTATTTTTAG
TTTAAGAAAACAAAAACAAAAACAACCACAGCATCTCAAAACTAAACTTCTTGGTACTACCACTAATTTTTTTTT
ATTGCCATTCCCTTTCTGTTTTGGTGTTGTTGCATCAAATCAATAAATCTGTTCTAGTTTCACCTTTTCCCATCA
CATTCATTTAATTTTTTGGATATTTCATTCATTTAATATTGATAACACTCAACAAATCACAACAGCCTATCCAAA
ATATAACATTGACACATACACTTTTTTTTTTTCCCACATCTTTTGATAGATCTGGTACTCCCCGTCAAACACACT
CTTGGGAAATAGGAGAATAGAAATATAACATCCTATTACAGCAACAGAACTACAACCCCCCCCATTCATTCAAAA
ACTACCAAAACAACCCACAGAAACATGGGTTCCAAAAACAAACGATATAGCTATTTACCAGCATCAAAGAATGAT
CATTTCAATGCAGAAAATGAGATTAAAAAATACCATTTAGATGTATCAACATTTGATGTTATAAGAGTGAATAAT
TTCCGTAATTACAACTGTTCGACTTTGTTTTGGTATTTTTACATGTGGGTTCTAATCTTTTTATCATTTGCATTA
TTAGCAACAGATATCTATTCTTGTCTAAATATCCTTGTATTCCATAGATGGGCTAGTGATGATTACAAGCCGTAC
GCATATTCCATTGCCAAATGGATTTTCACTGGATGTATAATATTTCAGTTTGTGCTACTATTTTATCATTGGATA
TGGGCCATACATATTGCCAGGACAAGAAATATTGCCTTGGTTTATCTAAATTCCATAGCCAAAAGACTCTATCTG
ATAAAATATTATGATAATTTTTGTTTATTAAACAGTATCAACGAAGGTCATTTTTTGATTGGTGTTGTTTTTTA
ACTTATTATGAGATAGATAATGCATTACAAATATTAGTGGCTGACACCCCAAGACAAGTTATCAATATATTGACA
TTAAGATACTATGCCACTGGTGGAGAGTTAAATAACAATATTTTGAATAACATTGAACAAATTGCCAATACAAAT
TTGTACTTGTCTATTATTTTGAGTTTCATGTGTTTATCGGTGTTCATCTATGCTATATTCTTCTTGAGGTTTGTA
TTTGGGATGCTTTGTTACATTCCATTAAAGATCCAATTGAGCAACGATGGCTATAAGAGTTTTAAAGATTACTGT
TGTCACTTGATTAACGAAAGTATTGCTGATGCAGTTAGGTTGCACCATAAACCAAAGAAAGTGTTGTTGGAGCAA
GGTATATTATCGGAAGAGAGAATTGCTCAATTGCCTGTGTTGGAAGATCGTCCACCTCGTTATAATGACTACTCA
AAAACTTTTTACCGTACAGATACCAGTGCCACATTGGAATCAAATATTCCATTGAATTATATGAAAGATAGATCA
AATTCCACCAATAATTCCAGAGACGATTTTGGAGGCCACAGTAACCAAAAAGTATATTCACCCATTAATGATCAA
AATAATGGAATTGGGAAACGTCTAAGTCAATTGAGAGAGAAGTATACTCAACCAAGTTATGGTGTAATAGAGAAA
TCTAAACCAGTTGATTCGATAGTAGGTCACGAACAACTGCTTTACAAGTCGAGACAAAGATCACAAGCTTCGCTT
TTGAGTGAGGATCAAAACGAATTAATGTACAAACAACCACGATCAACAAGCTTGACACATGACACATCAAGAACC
CACTTGAACAACCCACCAAAACGGTCTATCACTGACATTTCAGAACAAATTGGTCAGCAGAATCTACCATCTTCC
TTTAAGCCAATGAGAAAAGCTCCTACTGCACCATTAGGGCGTGAGAGTCACCAGAACAGTCAAGACATAAATTCT
TTAACTGGATATGACCAACCAGTACAGCCCTTACCAAAGTCATACACACAAGATCATCCACATAGACACAAGTAT
AATGATTATGCCGAACTGATAACGAACCCCTTTGGGAATCCAAGCTCAATATATTCAGGATCAGTGGATGATTTT
TCAAGACCGATGAAAACAGATTATACAGATGAGGGTATAAATCCGTTATACAGCCAGATTAAACCATTGAAAAAA
TCAACAACGGAACCTATTAATTCATTTGAACTCTCATATCAGACTCCACCTGAAACCAAGTTCAAGCGTTCGTTC
ACTGATGAGTATCCAATAACTGAAGAGGATAGATTACATTCCTCACAAGACGAAAGTAAAGTGAACAATCAAGAA
GAGGACCAACAACAGGGTAGTCCTACAGGAACTGATATTATAGATGACTTTTTAGAAGAATTGAATGCCCCACCA
GAAAAAGAACCTCCTTATCCAGTAAGAGGAGTTTCGAAATACTTTGAAACTTAGTGAAAACTAGACAAGAAAATG
GACGTAGTGATAGACTTATTTTATAGAATGAAAAGGTTTTAATGCATAGAAAAAGGTTCACATTCCTTATTTATAGT
AGATAAACAAAAATATTTTAAACACACATACATGTTTTTACTCAAAAAATACAGGCTTAAACAATATTGATAGCA
TATGTACAAGAACCCACGAACCTAATTCATTCAACTTTTCCCTCATGTCATCATCATGACTATTTTGGTTTTCG
TATTCCAATTTCAACTTTTGTAATTCTTCATCACTGATTGGTGGAATAGGGATATCACCAAGATCATCATCTCCC
ATTTTCTTAAATGTATACAAGTACACAGCTAACGGTATACTACTGACGGCAAATAAAGCAATAGTATTTCTCCAG
AAAAATGGAGCTCTTACTCTGTACAAGGCTGGCGTGATTTGATGAGTTTTTGGATCTCTGTAACGATCATGCCCT
TTTCTTGATAACAAAGGATGTTAGTATCAAATGCTATCATTGTTTCAAGAAAATTGGAATTTTTTTTTACTTACG
GTGCTCCTACTAATTTACCCATAGCTAATGATTATAATGTGGTTGTTTGATTAATACTGATGTTTGTTGTTGAAA
TGTTACGATCTAGCTTTGTATTTTTTTTTTCTTCCCTGTTTTAACAATCACGCTGTTTATGAGTGGACTTTGAA
AATGTATATGCAGTATTTTGTCCAAACAACAATACAAACATCGAGTATATGTTGATAGCATAAGAATTTATGCTC
```

```
CTCATTAATCTGTAATTAATACTTCGTAAAAATAGCATTGGCTGTAACATAAAGAGAGTAGAATAAATATACATA
CAGGTTTTATTACCGGTTTTCTAGATTATATACAAGAACCTAAACTATTTAATGTCTTTTGATGAACCCTTGATT
CACGCTATCTTTTCTTCTTTGAGTAGCTTCCAATTTTTTATTAGTTTCTCTAGCTTGTTTAATAGATTTTTCTTT
ACTATCGTCAACAAATTTGCTCACCATATCTTTAATAGATTGGTTTGCTTTAGGATTATTGGCTTGCATTTCTGC
AAGACTCAATTTAGGAGGCATACCAGCAATTTTCCTAAACCAACTACTTTTGAACAAACTACTTTGGATAAGGGA
AAATATCGAGTTAACAGCAAAATACAAAATAATAGCAGATGCAAACCCTTTAGTAATGAAAATAGAAGCAATTGG
AACAACAGTCATGACTTTTTTCATACCTGCTGCCATGGCATGTTGACCAGTTTCACCACCCACTCTAACAACAGC
AATGATGGCAGCAGCAGAAATAGCTTGTAATCCCAAATATGGATCAACTTCAATCAAATTTTGAAACCAAGCATA
CCCTTGATCAGAAAACCCTTCAACATTATGATTAGCCATTTTTCTCAAAGCTTGGAAAAACCCATATGCCAATGG
TAATTGGACGGCAGGAAATAAAGTGGCTAATGTGGAAACACCATTTTCTTTCATAATAAGTCTTCTTTTTTCCAT
AGCTCTCATTTGGTCAACTGTATCACCAGTCTTAATTTGTTGTAATAATTCGTCAATTTGTGGTTTTATTTTAGA
CATCTTAGTTGCATTAGATGATGCTCTGACATATAATGGAAACAAAACAAGTCTAACAGCAATGGTAGCAACAAC
AATAGTACCCCACCATGGTAACCCAGTATAAACATGAGTAACTTCTAATAATCTTTCAATCAAACTTGTTGGTCC
CCAACCTTGAGCTAGACCGATGGATTGCAAATATCCCAATTGATCAGAATGTAAATTTGTAACATTTTCAAGTAT
AGCAGAAGTGGTGGTATCATCAAATGAAGTCAATTTATCTTGGATTTCAGTCCCACTAGTTGTTGTCGATGAATT
GAATCTGATTGATGAGTATATTAAAGGTGACCGGGTGGCTATGTTAGAGGGAATTCCAACCCTAACGGTTTTCAA
AGATGCTGAAGTTGCTCTAAATGAGCGGGTCAACCCTAATCTAAGCATTATGGGTGGTATTATAGTTATAGTAAT
AGTTCTTAGATTTACAGTTTGATCAAAAAAATGAAAAAAAAAAAAATAAAAAAGAATTATTGTTGAAAAATTTC
AAAAGTCGTGTCTGGTCTTACACATTATTGATTGAGTGTTTCTTTTAAAGAAAAGTCTTTTTCTCAACCAATGTT
ATATAAGGTGATTTGGTTTATTGACAGGATCAACTCATAGAATGAATATTGGGCGTCGAATACGACCGAGGAAAC
TACATTTGAGATTATATTCTCAAGTGAAAGTTCCGTGGTCATTGGAAACTCCAATAACTCCTAAAACAGTTACAG
ATATTTTACCTCATTTGTTCAATTACCAATTGAAGAACAAGATACATTAATTGAAAACATCCTAAATTACTCA
ATGTACAATTACAAATAATGCTATATTCTGAACTGGATAGTTTGAAGACATTCAAATTTATTTGTAAGTACGGTC
AACATTTGCAATCAGAATTTATTCAGATATTTATTTACAATTTACTTTTATCAAATAACCTCAAGGCAACAACTA
CATTATTGCATCAGCTTTTACACGAAAATAAAGAGTTTCAAATGTCAAATGAATTATGGGCATTATATATGGATA
AAGTTTGTTATATGGGGATTATCTTGGGCAACAATGATATATCATGAATTAGTTGATAACGTAAAGTTTTATG
AAGAAACAAGTTATTTAGTACAAACAAATAATCTAATGCCATTCTTGATCAATGAATCTACCTTGGTAGCTTTAG
CATATATATTTAGAAACAACAAAGACGCGTCACGAGTTGGTGGCATAATACAGTATTTTCGTCGATTTTATTCAT
TTTTACGTTCACAATATATTTACAAGTCTTTATTGATTTTGCAAATTGAATCATATGCTGAACTTGGAGACCTAG
AACAATGTTTAAAATTATTTACAGCTTTTGGATTTAATCATAATCAAAGTGATGTAAAAAGAAACAGGAATGTGC
AAGCAGGATGGGAGAATATACACAAACGACATGAAGCCATCCAAACCAATGAGAATCCATTATTATACAAGGATT
CAAAATATGATTTGGATATTCACCAGAATTTATTAGCTGAAATTTGTAATACCGAGTTATTTAATCCTATCATTC
ATAGAAATGTCTATTCTTCATCTAAAACTGGACACAACCCAGTTATCAATGGATCTATATCTGTCAATGATTTGC
CAGCTTTGGAAACGTTAATCACTGAAAAAGTGGCTACCATGGAAATGAGGGAATTATTACATCTAACAAAAATGT
CTCATCAATCAATTAATCTTTTCATAGTTGCTGGATTATGCAATGTCAATAAACCACATATGGCACTTCAGTATT
TGAAAACATTATCACATATTTTCCCCACTATATCAAGGAAAAATCTTATAAAGAATCAAAATTTTATTCGTATTT
TACATGCTACACAAGATGTGGAACTCGCCAAGGAAGTGATGAACTATTATCGTGATATCCATAATGACTACATTA
ATGTTCAAGTGTTACAAGCGTAAATACTTGTTTTGTTGTCTAATGAATTCACTACAGTTTCAGATCTCATCCCTA
GCTTACAATTGCTTGAATCTTACCAAGATGTTAAATTGTTTGTCAATCCTGATCAATACGAAAAATTTTGTAAAT
TAACCAAAATACCAAAAATTATGACTTTATTCATGTACATAGTTAAAATAAAAACTTAAATGAAAACTAAACTG
AAATGAAATATAATATAATAATACTACCACATACTTTTAAACGTCAAGTTCGTTTTTTTACCTCATTATTCCTCT
CTAGGGGCAGACATTTTGTGAATTTTCACTCCTTTATCATTTAATTCTCCAACAACAGCAATATCCTGAGGAGTA
ATAAAAATATTCTGTGATTTTGGATATCTCTTTAATTCTTTCAATAACAATTTAATACTAATAGAACGATTCACT
GAATCCATATAAACATCAAACTCATCTAAACCTCTAATACGAGAATTCATCACTTTCCAAATAGATAACAATAAG
GCAAATTTGTGAAAATGATTTTTCACCACCACAGATAATGATTCCACGGTACGTTTCTTTTCATCGTTACCAGTTTGT
ACATTCAATTGTAATGTTTTTTCGGCAAAATCAAATTTCAAAGTACCTTGGAATCCTCTTAACCACATGGCTTTT
TCAAAAGTTCTTTTTGCCTCTTGAATTGAAGATTGGATTATAGTATGTAAGAAATTGAATCTAGCATTAACTTCT
GCATTTAATTTTCTTGATGCAGAACTCAAAGATTCTAATTCCCCCTCGGCTTTGTCACATTTTGCCTTTGCTTTT
TCTAGTTGGTCCAAGACTTCTTCCAATGAAGTTCCAAGAGCACTTTCTGCTCTTTCCAAATCAAAACGAGTCTCT
TGATAATCTTGTGCTATCGTCTCTTGGGTATCATTAGGGTATATGGTAACTCTATCTCTGCTACAATGTTCTTCA
GCTTTGGCAACAAATTCTTCCAATTTACGATTCCCTTCAGCAAGTATATCGTCAGCTCTTTTGATTCTATCTTCC
AATTCAGTTATCTTGTATAAATAACGTTTTTAAGGTCCTCTTGGGTTTCAATTTCAGTTTCAATCTCAACTAAC
TGTTTCACAAATTTTTCTCGAATGGTTTCATGTTTAACTTTTTGGATTTGCAATCTTCAATTTGTGTTTCAAA
TCCTTATAATTTTCATTCATCTGAGAAAGATTTTCTAATAATGCTTCGTTCAAAGCAACCAATCTACGGATTTGT
TCATTATTGTCTTCTATTCTTGCTTCCAATGTGGTGATATTTGAATAATCAACTTCAACTTCCAATTGATCCTCT
AAAGTACTACGATTTCTTTTCAATTGATCTAAATTTCTCTTGATGGCACGAGATTCAGATACAAGATTATCTCTC
TTGGCATCCAATTTCATTTTTATACTTCTGGCCCGTCTTTCTAAATCATTTTGATGTCTATGTTCTTCATCCAAT
TCACGTTGTAGATCACTGATCAAATCTGACATTAGCGACCCCAAACCTTGGCCATTCCATTTTGGTAGTATATA
GGATCTTGTCTAAAGGTGTTGTTTTGATAACTCATTCTATGACCGGAATCCTTTCTGAAAAGAACTAAAGAATTT
TGGACATTTCTTCTCCTGCATGAATCTCTAGCTTCACTGGCAGATTCTACTATAACATTTTTTTCAATGGAATTT
```

```
ATATCAATCAAAGCATACAAAATCGTATCATTTTCCACATTTAACATGTCTAAAACAGTGGTGAATGCAGAATCT
GCTTTACCGGAAGCATAGTTCAATCTTTCTGTTTTCTTGACAATAATGTTGCTACGTATTTGATATTGCTTGAGT
AATCTGTCCAACCTACTTCTATCACCTTCATTGGTAACAATAAATGAATCCAAGGTTTTATTCAAAATGGTAGAT
AACAAAGGTTTCCAATTATTGTATTGATTCTTTACATGAATATAGCTACCAATAGGACCGATTGGCTCTTGCACC
CAATCAGGATGTCTTTTAATCGCTTTTATCAATTCAGCCATACGAGAACCCCAAGGCGAATATTTTGATACAGAC
TCTTTCTCTAATTGACGCTTTTGGTTTTGTAAATCGGCAATTTTCTGTCTTGATTTCTCCCTTTGTTGACTTACA
GATCTCAACTCGGGATCAGGATTATCTTGCATTTCCACAAGTTGTTTTTTCAAATTTTCCAATTGACTTTCCAAC
TCATCAATTTCAGAGTTTAACTTTTCCAATTCTTCAGCCATTTTCTCCTTGTTTCCCCCTTGTAGTTCTTGAATT
CTTCTTCTCTCCTGTTCTATCTTAGTCTCGGTCCTAGTAATATCTTCTTTCAAACTATTCATTTCATCAATATTC
TTTTTCGTTTCCTTTTTATTGATTTCTAACTCAGATTTCATCTCAGATCTTTTGCTTCGAAGTCCCTCAAATTCT
TCCACTATATCTTTTATTTGGCTTTCCACTTCCTTAACTTGCTGATCAGCAGCATCCTTTCGAGGAATTTTTGCT
TCAATTTCTTTTTCACAAACATCAATCTGGTTTTTGGCCTGCTCAATTTCTTGCAAGCAAGTGTCTTTTTGTCGA
TTTTCTTGATCAATTTTTTTCTCGATGGTTTGAACATTGAACCAATAGATTTTGGCATTCAACATTTCCAATTTG
TTTCTTAATGCATCATTAGTTCTATGCGCATTATGAACTTTGGCAATTGCTTTGTATTCTTGTTTAGCCACCTTG
GTGTATTCTTCAGCTTGACGGACTTTTATTATCCAACACTTGGACATTGTTGGAAATACTTGTATAGTTTTCAAGG
ATATCAGTGATAAATGCCCCATCCATAAAATATTCATACTTGTTTTTATCACTCGATGATGTTAAGAATTCTCTA
GCTTTGTCTTGAGACAAGAAGGCGAGTGGATTATCAATGGTGATAGAAAACTTGTAAAGAATCTCATCCAAAACA
CTCTTTTTGTTTGACACTACTTTTCCTGCTTCATTTTTAATGCTGTATGTATTGGAACCAGATCTTTGTAATTTT
CTTTCAATAATGATTTTCTTCCCGAAAACGTCTGGTTTATACGCGTCTGACCCTTCATTTTTGAGAACCACTGTG
ATTCGAGAAGTAGATTTCCCATCTTTGATTAAATCTCTGATAGTGCTTCCTCTATTTGTATCAGTTGCTTTGGCA
CCTAACCCTACAGATATACCAGTTAAGATTGCACTCTTTCCTGACCCATTTCTTCCAATAATAAAATTCAACTGG
GGTCCCAATTTCAATTCAAATGAATCGTGGCACATAAAGTTCTTTAAAGTTAATTTCTCAATAACCCCCGCTTTA
GCCGGATCTGAACCAACGTCATCATCATCATCCTCCTCCTCATCATCATCGTCGTCGTCCTCATCGTCTTCATCA
TCATCTGATTCCCCGTCAGAATCCGAATCAGCACCTGAAATAGATTCAGTTTCTGATGCACTTTCACGTCCATTT
CTACTAGGGGCTTGAGTCATTGTTCTTCGTTTTCTGGGTTGATCAGATGAGTTAATCAATAGTTGTGACATATAT
TCTGACACGCCTTCACCACCATTTCTGGCATCGAATAAAGAATCCGCGTCATGTTTCCTTTTATACGGTACAGTC
ATTTGGATAATATTCAAAGTAACATAAAAATATAATACCACTTATACACCAAAGAAGTTTAATAGAGTGTAGATT
TGTTGCTGTTGTAGATAATTTGATTGATTTTTGGGGTGTTCGTGTTTAACTTTTGGGATTCAATTGTTTTCTGA
AATCAAAAGAAGAAAGAAAAAAATTTCGTGAACAACCAAAAAAAAAAAAGAAAAGAAAGCGCTTCAAACGAGTC
GCGTCTCAATTACCAAAAAAAAAGATAAAAAAATTGTTTGAACGTGACAAGACACGATATGCCCTGCTTACATAA
TCAAAAAGTTTATTAACTTCTTTTCAGAGAAAAATTATCAAAGCAAAGGCTGCATTATGCTTGATGCAAATACAG
GGAGCATACTGCTGTTAAGAGGGTTTTTTTTTTTGGTAGTGGTAGTGGTAATAATAATGATGTTGGTTGGAAATA
TAATAAATTTCACAAGACAACTTACTACTTCTTGGTGGGGGAAGGACCAACTAATATTTTTTCTCTCTTATTGT
TGTTGATGTTGGTTGTTGATGAACAACAAAAGAGGTTCCATCTCTCTCACTTTGCAACTATCTCTTGTATCTT
AAACCCTATACTAACAGAGAGAGAAGAAAAAAAAGTTTAGTTTATAAGCATCTTTCAGTCACTTTTTTCTTTACC
CACTACTACTGAATGGTCTAATATTCCATTAAGATGATAACCTTGTTAATATTTATTTTTGCATTTTTGGGAAAT
GTCTTATGTTACCCACAAGCCATTCTTTCTCATCAAATATCTCCCAAAGTGATGATAGTATCAATGTTTCAGCCA
GAGGAAGAGGCATGGACTTCAAAAGTTGATTTTCAACACAACATCACTGTTCCAGGTTTACATCCATTATATCCA
AATGTTCATTGTACTTCCAATTTTGATATTTGTCAATTTACCACTGGGGAAGGAGAAATAAATGCTGCCAGTTCA
ATAGCATTTTTAATTTCAAATTCAAAATTTGATTTCTCAAAAACTTATTGGTTGTTAGCAGGAATTGGCGGTGGT
GATCCTGCTAAAGTAACCACTGGATCAGTGACATTTGCAAAATATGCTATACAAGTTGGTTTACAATATCAAATA
GATTCTCGAGAATTAACTAACACGAATCATAAAGAAGGTTGGACTTCTGGATATTTTAGTTATGGAACAAAACAT
CCTCAAGATTACCCTGATTCGGTTTATGGTACTGAAGTTTTTGAAGTGAATGAGAAATTAAGAGATAGAGCCATG
GAATTATCTCGTAAGAATGAAAAATTGTTAAAACTCGGTGATGACGATAATGTTAGTTTAAGAAAGTTGTATTCA
AGTCCTGCCAATAAAATCCCCACCATTTTAGCTTGTGATGTTTTGACTAGTGATAATTATTTTACCGGACATGTT
TTGAACGATTATTTTAGTAGTTATTCCCAGTTGATTACCAATAGTTCAGCAAATTATTGTTCGAGTGCCCAAGAA
GAAAATGCTACTTTGGAATCGTTTATTAGAGTTGCCAAAAATGGCTTGATTGATTATGAAAGAATTGTTATTTTG
AGAACAATTTCTAATTTTGTTGCCAAACCTAAAGATTTATCAATTGATCCAATTGAGTTTTTCAATGAATATCCT
AAAGGTGGTATTCAACATGCATTGGATAAATTTGTATATTGGTGGTTGGCCATTTGTTGAAGATGTCGTCAATAAT
TGGGATAGTTTATACAAAGATGGTCAATCTTTTAGAGCAGAGAATTATTTAGGTGATATCTTAAACACTCTTGAC
GGTCAAGGTAAAGATTTTGGTAAAGATTCTTATCACATCAGTTGATACCAGATTTAATAATTAAACTTACTACAG
ACACATATAAGTAACATACTAACAGATTTTGATAGAAACGGTCATTCTAATCACAACTAATAAATTATAGAAGTC
AAAAAAAATTGTCTAATTTTTCATATATTGATTAATTAAACAGAACAGAATATAATGAAACCTACTTTTGTATCGT
TTACTCAAACGGTTCATTTAGTAAACAAATTGAGATGAGACCTAAAAAGTTTCACAAACTAAAATGGTCCTACAA
ATCATCACAATTACACTAAGAACAGTACAATACCGTTACATTTAAATGTATACTAAGTTGACTTCTTTTATCTT
GTTCCTAATAATATTTAATTTCTTTATCTATTTGATGCCGTGCCTGCTTTTTAATAATAGGTGACAAACTTCCGA
TGCATTTCCCCGAAAGTGAGAAGTTTTGCCGTTCCATTGGAAAATCGGAACATTCTTTCAGCAGCAACAAAAACA
ACAATAGTTTATCAGTTTTCCTATTTGGGAACAAAGCTATTACGATTTGTTTTAATTTATCATTATCAACGAGTT
TAAAGTTACAGTAATTTATTTACTAAAAAGATAAAGGAAATTACCCATTTAATACAATGAAATGAAACTCGGGGC
```

```
ACAATAATAAATCCAATTAATTATCACAATGTACCTCATCTTAATTCTCTTCACTGCTCTGCTCTTTCTTTTTGA
TTGCACATTAGATGATAAATACACACACACATATATATATATAAATAGATCTACAAATCTCTTCTATTAAACTTT
TCAGTTTCAAAAAGAAAACAACAGCTTTTGTTTTTGCAATTGTATTCCCCCCTCCGCCCAAATATCATCATGAAG
TTATCCACTTTATTTACATTAGCCACAACCATTTCTACATTGACTACTTTTACCATTGCCAGTCCCGTAGTAGTA
GTGGAGAAAAGAGCCATTAATGAAACTGCATTAGCTGAAGATATCCCAACCACCAAAAACAATCATGCTCAAACA
TCATATGGGAAACCATTTGCCATTTATCAACCAAAAGCATTTATTATTTCCATGTTTAGTTTAGAAAGAGATCCT
TGGTTAAAGGCTATGGATTTTGTTCATAATATTACCATACCGGGATTATCACCAGTTTATCCCGATATTCATTGT
ACAACAAATTATACCATTTGTCAAATCACTACTGGAGAAGGTGAAATTAATGCTGCTAGTTCAATTTCAGCATTA
ACTTTAAATCCATTATTTGATTTAACGAAAACTTATTTTTTAGTTGGTGGAATCGCTGGTGGTGAACCAAATTAT
ACTACCATTGGTGGAGTTACATTTGCTAAATATGCCGTTCAAGTTGGATTAGAATATCAATTGGCTTATGAAGAT
TATCATAAAACTAATCCTGATTGGATTTCCGGTTATATTCCATATGGTACTGATGATCAAAATACTTATCCTGGT
AATGTATATGGTACAGAAGTATTTGAAGTTAATGAAAAATTAAGAGATAGAGCCGTTGAATTAGCTTCTAAAGTT
CATTTAAATAATGGTACTGAAGGTAATGCTAAATTTAGAAAATTATATAATGAAACTGCTGCTCAAGGATTACCT
AAAGTTGTTAAATGTGATTCTTTAACTAGTGATAATTATTTCACTGGTAATGTATTAAATGATTATTTTGCTAAT
TTCACATTATTGATGACTAATGGTTCTGCTACTTATTGTTCTACAGCTCAAGAAGATAATGCTACTTTAGAAGTC
ATGACAAGATTGGCTAAACATGGCTTGGTTGATTATGATAGAATCATGATCATGAGAACTATTTCTGATTTTTCA
AGACCACCTCCATCAATGTCAGCTTATGAATATTTCTTTAATAGAAGTGATGGTGGGATTTCTGCAAGTTTAGAA
AATTTGGTTATTGCTGGTACTCCAATTATTCATGATATCGTTCAAAATTGGGATAAAATTTATGAAAGTGGTGAA
AAATATTCTTCTAAAAATTTATGTTGGTGATATCTTTGCCACTTTGGGTGGTAAACCAGATTTCGGTAAAGAATCA
TTTGATACTGCTTAATTAATACCCCCTCCATGTTCTCTTCCCCACAAAAGGTTAAATCAACTTTTTCACGTTGTC
TTACATTTCTACTATATTCTTTATTGTAAAACATTTCTAAAAAATATTCGTATATATATATATATATATGTATGT
ATAAATTATATTATCATTATCACTTTCTATAAATACAAAAGTGAGCTTTAGAAAATCACATTTTATATTCAAAAT
TGAACTTTAAGCTCCTCTTCTTTACCAAAACCTTGACCAATGAAATTTTGATTGGGTTTTGTAACTGTCTTATCG
GTTCTTGTAGTGTCATCGGAAACTACTTTCGTAAGATGATGAACACCATCATCATTTGGGTCAACACCACTTTGG
ATAACATTGTTCTTGCGTGGGGTGTTATTGTTATCTTGTCCAAGTCCCAGCTGTTGTTGTTGTTGATATTGTCTT
TCTCCCAATTTCAGATCCACCTTTACATCAACATGTTCATGCTGATGCTTAATACCAAAGTCATACTCTTGTTTT
TGTTTTTGTTCGTGTTTGTTCTCTTGTTCACGTTCAAGTTCGTGTTGACGTTCGTGTTGACGTTCGTGTTGACGT
TCGTGTTGACGTTCGTGTTGACGTTCGTGTTCGCGTTCTTGTTCACGTTGAGGTTCACGTTGGGGTTCACATTCT
GGTTTGACTTGAATTTGAATATGATGTTCATGTTCAGGTTCTTGTTCATATTGATGATTTTGCTGTTGCTCTTGT
TGTTGACTTTCAATCTCGGTTTCTGAATTTTGTCCCTGCGCGTGATTTAAATCCGATTCAATGTCTTTCTTTTCA
TCTTCTCTATCATCAAATACTTCGTGATAATTATTAATCAATTTTTCTAAAACCAAATTCATAAACCCAAAATTA
TTAATCAAAATATCCAAATTACTAGATTCTGTTAATGCTGGCCCTATCACCGTAGCAATATTTGATGGTGTCATT
TTATTAACTTCTTTATGTTCACTGATTTATTCAAATGCTTTACCAAAATTTTTAAAGTGTTGAAATTGACCACT
GGTAATGAATGTAAAATTTTTGATAAGCATTCAAATCAAATGCATCACGATCTGGGGTTTGGTTTTTATTTTCT
TGTTCCAACTTCAATTCATAAAATTGACTAATAGCATCATCAGTTATTAATGAATCTGGTAATTCACGGAAATAG
GATTTGACAATACTGGTCAAAGCATGAGTATCATATCCCCGATCATTGAAATTGATAGTACCTGTTCTATCAATC
GTTTGTTTAATACTAGTCAACTCACTAATGGAAGAACTGATACGATAAATACCAACATCTTTGATTCCTTCGGAT
TCAATTTCTTGGAATATGGCTTCCAAAAATTTCGGAACAACAGATAATTCTCTAACACAAATAAAACTAATTGGA
ACGCCAAAGACAAGATTATTGTTTGTAGTTTTGTTGTTAAGAATACGTGAATAAAACCAATGTCTATTAGCGTAA
TTTAATTTAATTAACCATTCATTCAAGTCAGTGTCATTTGTAGCTTGGAAAAAATAATGATCATTAGTTGTTTCA
GAATCAATTTTAAAACACAATGGCATAAGGTATACAGGGAAAATCTTTCTGTTTTTTAAAGGTATCACAACAACT
GGCTTTTGCTTTGGTTCGATCGAATCTTCTGGATTTGGTAATTCTTCAATATTAACAACTCTTTCTGGAGTGGAT
GTGTTTCCAGTTAAAGAAAATGGCCTTGATTTGGTAAATAATCCACTTATTTTGAATCTAGATGATGAGCTTGAT
TTGTATGATAATGATTGACGTTTCAAAGATGTATTTGATGTTTTCTCGTCAAATTGTGCATTCCACTTAATGCA
TTATTATTGTTGTTGTTGTTGAAGTTGTTGTTATTGTTATTGTTATTGGTATTGCCGGCAGCAGTGGTA
GTGTTGCTAGTGCTGGCACTAATTCCACTATGAACATTACTGAAACTGCTATTGGTGGCAGAACGAATAGATAAA
TTGTTTGTACCCTTAATGAGTCTTTTAGAATCTCTAATATGTTTCTTTTGATTATCAACAACTAAAATTTGATGT
TGATCTTTCATAATTCTTTGGAAAATTTCAGCTTTGTCAACAGGAGAAAATTCTCTAAGATTTTGTTGATTCACT
AATGATTCATCCAATTTCAATAAAAAGTCAAACTCACGAGATTCATTAAAAGTGAAATCATTAGAACCCGATTCA
CCTTCAAAATCTTCCACACTTAATTCCCTAATCAACTTATAAATCAAATATCTCTTGTTAAAATTGATTTGATTT
TTAAAATAGGAAGGACATTTATCAGTTTCAATCAAATTCTCAATGATCCATCCAAAACATGGCAATAATGGCTCA
GTCGATTGTAAATCATTGATAGTGATATTTGGTGGCAATAACAGTTCAACGCTATCAAAATTCCCTTCACGATGG
GTTAATGTTTGAGCTGCCCTTACCCATAAATTCGAAAATTTACGACTCTCGGGGGAATAAATCACATTAATAATT
GCTGTCTCAATACATGATGGAATATTACCACTACCTTCAAAAATAAATTGATTATCACTCATTTTAATTTCGAT
ACTTCAGCCATTATCAATAATGTTTTCATTCTATCTAATCTTTCATCAGTGGTTATGTTCAAATCAGTCAATTGC
ACCAACAAATAACTTTTGAATTTAAAGTACACTTTGAACAATTTACGGAAAACAAGTGGGAATTTTTTCAACAAC
AATTGACGTTCATCTGGAATGACTAAAGATTCAAAAAAATTGAATATATTGGAAATTATTAATTGATCATCCAGT
ACTGTAGGTTTTTGTAAACTGAAATCTAACAAGGCATTCTTTTCAAATGAGTTTTCCAAAATCTTGTATACCCTA
```

```
ACCCAATCTTCAGTTTTTATTCCCTTGTAAAACACAGCTAATAATTTGTTGAATTTATACAAAAACTTTTCAATT
TTATGAACATTTCTATGACTTGGCAAATTTCTATTCATGGGCACTTCGTGAAGTGAATTGTTGAATCTAAATTCT
GAAATCAAATATTCATCAAATTTCAGCACTTCAACTGGTCGATAAGTTTTTTTCACAAACAATTTCTTCAATTTT
TTATAATAAGTTACCAAACTCTCAAATGATTTCTCCAAAGTATTATCGATTTTGTTTGAATTGTACCACTGTAAA
ATTTCATTACTGAACAATTTGAGTAATTTGATTAATATATGTTCTTGTTGGCCAAATCCAAAGAAAAATTGGAGTAA
AAATTATTTATCAAAACAATCAACACTTTTAATATATTGATCTGGATCTTGAGTAACAATTCATAGTCAACGTCT
CCCAACTCATTCAAATCTACTGCAGTATCCAAATTCCAGTTTGGGAAATTCATAGCCAATTGTGGGTTTCCTTGG
TTAAAATTTGGTTCCATTTTCGTCTTGTCCGATTCATGATTCAATTTTTTGAGTAAATAATTCTTTTTCATAACC
GATATCACCGCGTTTCCTGAATTTATAAACCTGTGAGCTAATTTATCTAATAATTCCTTTGTTGTCATAAATGAA
TTGTAGTTTAATAAAAAAACAAATCTATATTCAGTTAAATCAAGGTGGACATCACGGTGGAAATATTTGGAATCA
AGCAACAACAAGTCAATCAACCTGTCAACGGTAGCATATTTAGGGATGAATTTGTAAATTTTTTCATACTTCCA
TCCATGCTTAATTTCCTTTTATTAGATTTGGAATTATTAGCTTTTGGTGACATCAGAAAGTTTGTGAATTTATCA
GAATTCAAAATATCATCAACATCAATACCCAATCCTGGAACATCATCATCGTCATCCCCTCCGGCAAAATCGTCA
TATCCACCACCGGCTCCAACAGCACCACCACCAGTAACAGAACTAGTAGAGCTATTATCTAATTCAGATATAAAA
TCATCAATTCTAAACGTCAATTCATTGTCAATAACAAAATTGTGTTTGTTCACAGATGGATCTAATGGTGGTGAG
TCCTTTTTATCACCTGATTTCATCAACTCATCATATTTGCCCAAATCAATTTTGAAAAATTTGTTATTAAAACTA
GGAATTCGAGAAGCAGGGTTAGATTCACTCAATGGAGTCTCATTCAGAGAACCTGATGAATCAATTGAATTGACA
GACAAATTAGATCTATTAATATTGCTTTTCAATAATGTTGATTCTTGCAGTGTTGAAGGGCAACGGAAATGGAA
GTGGTTGCATCCAAATATGCTTCAGGAAGTTCTGGTTCCAAGTTTATGGATAATTTCATGATTTTCTCCATATTT
ATCGAATCACAATTTAATTCAATCAAGCGCAAAAGCTTATTCTTTATATCATTGTTTACTTCTCGACGTTTTATT
GGTGATGGTGGATTTTCAAGTTGCCTTTCGTCACTATTATTGGCACCCAAAAACAATACTTGGTTTAAGCTCTCA
TTAGAAAATATAAATCCCATAGAATCATATCGACGTAAAACATCGTCATTGTACTTGATAATTTCATCATAATTG
GTCAAGTTGGTCAAATAGTCATTCCATCTATCAAAGGAATAATTTACTCGTTTCCATATCGATTCAAGTTCATAA
ATATCAACACTCTTATCGGTAGTGTTCCCACTGTTGTTGATTACTAAATCTCCAAAGAAAGGAATCACTCTTTCC
TTAGGATAAATTTTCCCTAAACCTCTTGGTGCCATGATATGATAGGAGTCTTTAGTGCTCAAATCTCTGGATTCT
TCGTTACCTCCTAGATGGGTTGACTTCCCATGATCAATAGTAGCTCATTAACCAAGTACCTTCTATCCAACTCA
AACAAGACAGGTGACCAATCGCTTTTCAACAATCTAATATAATCTGGTGCCACTAACGACCAGATTTTGGTTAAT
CTCAAAACCGGCTGTGATAATATAACAGATGATATACCCAACCAGGATGACATGTTACCTGATTTATCTAATAAG
CATCCTAGATCAATCCATTTTTCCAATAATCTGGCTTTGTTTTCCAAATTGGCTGAACTCATGTTCATACTCGAA
TTTTCCACAAACAAATGATTTACCAACAATCTTGACAAATAATGAATGTGATAATCATTATTGAATATTAAAGGG
TTCTTTTTATAGAAAAAATCTCGATTAGTGTCATCGCTAATTGAAGAATATAGCAATAAGGATTTGTCAATATTA
GAGTTCCAGTTACTAAAAAACTTTAAATCAATTTCACTAATGGTATAAGCAAAATCAATCAAATTAATTTCTTTC
ATAAACACAGTGGAATTCAAATCTTGGAATGGTTGAACATTAAGTGGTAAATTATCATTATTGAGTAAATCTATC
AACACTTGTTGCTTTTGAAGCATTTTGTTTTTGAAAATAGTGATATCTTCAATGTTGTAATGATTGATCATTTCC
AATACTTTCAAAATATAGGGGGCAATGTCAGATTTTAATAAAAATCCATCAAAATGTTCTTCCAAATTCTGCAAC
ACCTGCAAAACTCTGGAGACAACCAATTCCAAGTTTGTCATGCCCTCAAATTTCTTCTCAAATATAGTGTGCACG
TAAAGAGAGAAAAATTTCATGATTTTCCCAAAATCTGGTAAAATAGGCAAAACATCAACTATAGTGTTGATGGTA
CGGGTATCCAAAGGATCTTGATTGAACAATAAAAAGTGGAAAATGGCTTCTAATGAATTTTTCCCATCTTTGAAA
AATGGAGCTGAAAATCGATGTGTATCAAAATCATATAATAAGTCTGGATGTGGCACCTCAACTTTGTAATATGTA
ATGTTGTGCTCTGATATATCTATAGAAGAAGTAATGGGTAATGTAGGTGGAGCAGTTACTGGTGTGTTGGGGATA
CTACTAGAATAAGGTGTATGAAATACATTTCTATTGACTGGAATTGTTGTGGTTTCAATGGTGGAATTTTTCCGC
ATCCCCAATGGAGGTGGATGTGCTGTTGGGGTATTTGAACAATGGGGCTACTGATTTGTGAAACATCTAATGGT
TTGGTATCAATTAGAGTTGAAGCATTAGTTTCAATTGTTGCATTGTCATTATTATGTTGAGGAGGATCAGAAACG
ACATTTTCATTAATGCTATTACTGTTAGCTAATGAAGTGGAACTATTATTGAAATTATGGATACTGCTGCTACTG
TCATTATTATTCTTCATCATTGCTTCAACTTCTTTGGGTATAGGAGGTTCTTGTAATCGAAACTTCTTGACATTC
AAATTTGTTGGTGCCTTGTAAAGATATAAATGTGATCCTTTTAACTCGGCACGGTACAATTTCAAATTATTTTCA
TTGATTTCAGTCCCATTGAAAACACCATTCACCCACGAATGTTTCCAACAGTTGTATCATGATCATGTTTAATT
AAGGAATTCAATTTCACATTAGGTGCAACTGACGATTGGAATTGGGGAGAATTGAGTTTTTTGTTGTACCGCCA
CCACCACCACTACCACTATTTCCTGTAGCTCCTACTCCTCTAATAGATGTAGATGTGGATGTATATGTATGTGGT
TGAGTATTATTCAGTGTTGCCAAAGTAGAAGCAGCAGTAGTTGATGATAAGGTAGATGTATTAGTTCTGGATTGT
TTATCTGATAACGAATATGGTTGTTCGTGTATGGATGCCATATCTTCATAATCAAAACTGGTTGTATCCTCGTGT
GACTCAGTGTGGACAAGGTGGTGATGTTGGTGTTGGTGGTTGCGGTGGTGATTGTGATTATGATTCTGATTGTGG
TCAGAATATTGATCCGATCCTTGTTGGTGTGATTGTGTAGGCAAGTGTTCATTAGAATCAAAGTGATGATTTGAA
TATATATTTGGTGAATTAGTATCGTGAGAAACACTCTTTCGTTTATCTTTATCTTTTCTATTCCAAATCTTTCTC
ATGATGGTTGATTAAAATATTAGTTTGATATATTTGTTAGGTATTAATAATAAAAATCAAAAATCAAAATATAA
AAAAATGGATATGTTTGTAAGATCCCAATAGATTTATAAAGAACAAAGACGGAAGGAAAGAAAGAAAGAAAAC
AATTAAATAAATGAATCAATAAAGTGAACTGAATTGAAGTGAAGTGAACTGAACTGAACTGAACTAAAATGAAAT
GAAATGAATGAACAGGTTGTAAGAAATTTTTAAAAAAACCCAGGAAGAATTTTAAGATTTAAAATTTTAGAAAGA
```

```
AAATTTAATTAAGAGTAAGAGAGACGGGTCGCCAAAAAAAAAAAAAATCAAAAATCAAAAAAAAAAAAAAGTTGT
TGAAAATTAAAAAGTAACGAGAATGAAATATACATAAAAAACATAAAAAATAATACCATTAATATATAATAAATA
TACCNNACCACCACCAAGAAAAAATCCACCACCCANCTCCCTTCTACTTAGTCTTCTTCTACTACTTCTTGTTGT
TGTTGCTGTCGTTCATACCTATTTTTTTTTAAAAATAATTTGTTCCCATTTTGTGTATGTCTTAATATCCATCTA
TTGTGCAATGGTATAGTCTGTTATTGCTTTTTCAAGTGCTGTACGTCTAAACTATTTTTAAAATAACAATCAACA
AAAAAGATAATACAAAATTATGACAAAAATTTACATACAGAAACAAATGGAAGAAAAGGAATGTTCATTGTCAAT
GTTAAAACAATAAGAACTAAGAAATAATAATAAGAAATGCTTGATTCATTGTTATTTTATCCACCACTAGTAAG
AACAACAACGAATACTCATGCTCATATTAGGACCAATCCTCTTAGCTATTCTCTATCTCTTTTAAATAATGTCTC
TGTAGAGTATATACACATCTGGTTATCAATTTCGTTATTGTGGAATTATAACCAATTGGGAATAATAATGAGGAG
GGGAGGGAAGGACGAGGACGAGAAAACTGGAATGGAAGGCGGACATAACTAAAGAGCAAAAACGAAACAAAGACA
ATAAAAACAAAGTGTGACAAAACCAAAAAAAAAAAAGATAAAGAAGCAGAACAGAACAGAAAGAATTAAAAAAAG
CGATTAATTATCGTCTAAAATCTTTCCAAATTTAAAACAATCGTTGAACTCTTCAACAACAACAACAACGCCATT
ATACAACTTGATAAATGGTTTCTTGATTTGAAAAAATAAAATCGTCTAGCATGTAACAGCATATATATTTGATAG
GAAGTTCTTCTCTTTTTCTCTTTTATTTTGTGTATATTTTTAGTAAGTTGAATGAAATGGAATTGAAATTGAAAC
TGGAATGTTAAATCAATACATGTGTAATTTAAAATCAAAAAATCAACATTAAATCAAAATCTAACCAGTCAAACA
ATTTCAATATGTAAATTGACGTGTATTTTAACCCTAATAAATTTTTTCACCCCAATGATTTCTGCAATCGTGTAA
ATGTTTCAAAAATGACAGTTTATTTCTCGCTTGCCTGTGCTCGTAATAGCTAAGTCTTGTGTATGTATAGACTAA
TAAATTGAGCAATAATGTAAGAAGATAATTATTTTTTTTTGCAACAGAATCAATCAATCAATTAGTGAATGGTA
GCTGGTGGAGGGGGAGATATTTGCGTTATCGATTAAACAAAATTCTTGGTAATTGATTAATTGATTAGTAACGT
AATCTTGTAGATTTTCAATATCTGATCATTATTATTTGGCAACACGCCAATTCGACTTGGAGTTTGTTTAGCAAC
AATATCTAATTCAAAGCCCATCAATCAGTCAATTCCCGTTTCTTTATTATATCAAGTACCCTGTCAGTCAGTCAG
TCAGTCAGCTGATTGTCATATGTAAGCTAGTGGGTGAATTCCTATTGTTGGAAACTATTAAACAATCAACCTGTT
AATATTACTTTTTTGATTTATTCTGGTTTAGACGTGCAGCACATAAAATAAAATAAAGTAAAGTAAAGTAAACGA
CAAAAAAAAACCAATAACGCATAATGACATTTCTCATTAACGTGTAACATTATAATCACAATAATTTTGTAGTAG
GGGTAAGAAACAAGAATTTCGTTTAACTCTAACTTTAACTTTCACCAAATAAAAAAGAAACCACAAACGACAATC
TATGAAGAGGAGGAAGAGAAGGAAATAAACGTAATATTCAAAAGAGGAACCTGAAACACTTAAAAGGGAACCGCA
AAAGTTGCTGGCATTGTTTCATTACTTTACTGAGTAATAATATTACAAACCATTCTAAAAATATACCACTAGTAA
CTTATGTAGACAAATCAAGATTGGTTAAATTATCAAACACAATAATGAATTCAAACAAGCTTTTTATTTTATGTT
TTTTTTTTAAAAAAAAAATGTCACATTTTTGGTTTCACCCCTGAACCCCTTTGTTTTTGGTGTAACTGTTTGTG
TTATCTATGTATTATGACAACATTGATAATGCAATTAACAAATCGTTTTGAAATGATTGATAAGTCTAACCGATG
TCAACAACTCTCAATTATAATCCTGTTTCCTATAATAAATCTAAGCTTCAACCATTAAATAACTGCAAAACAACA
CAGAGAGAGAGAACTTTTCAATGGAGACTATTTCAAATACTAAATTAAATATCAACGCACAATCTAAAATGACAA
AAAAATAAAATAGTACTGTCAAAAAAGGGGAAAGTGTAAATCTTTTTTTCATACCCACTGATAATAACTACTTTG
ATAACAATATCAAAAGCCTCAATTAAGCCAATTCTTAGCTTAAGCCTTGTCACAAACTAATTTAAAATAACCAGC
TACACCTCCTTGAGTATAAAAAAGAGACAAAAATAAAACATGTATATAAAAGCTATAATAAATCTAATAAAAAAA
AGGAAGACAAAATTATCAAAAAAAAAAAAATAAGAAGAAATAAAAAAAGTATACTAATAATAGTTGTAGGAGCAA
TTAACTTATTAAACCTTTATTTATCACTTTAAAGTGACTTGACATCCATCCATTAATCTCATGGTAGCACCAACC
AGTCTTCTACATTCTGTATGGTTTGAATCCAATTGAGAAAAGTTTGTAAAAGTCTAATAGTAACATAACTTGCT
TCAACTAAAGCAAGTTGTTGACCTAAACATAATCTTGGTCCAAATGGTCCAAAGGCAACTCCACCATTT
CTAGGTAAATTAGCCCATCTTTCAGGAATATATTTTTCTGGTTCAGGTCCGAAAAATCTTTCTTGACGATTACTT
GAAAATAATGGGAAAATAACTTGTTCACCTTTTCTAACAAAAATTGGATAATTATTTCCCTTTCCACCACCTTTT
GGTAGCACGGTATCTCTATTAGCAGTTCTAGTATTAATGGGTACTGGAGGATTAATTCTTAAAGATTCATGAATA
CACCAACGTAAATATTCACAATTATGAATGGTTTCAAAAGTGATTGATTCAACATCAGGGAAATGTTCAGTGATT
TCTTTTTTCAATTTATTCCATACGGGTTTATTTTGAGCCAATTCGAAAAACATAAATGATAATAAACTAGCAGTA
GTATTTCTACCGGCTAATAACACACTTAATAATTCATCTAAAATCACTTTACGATCTTTTGTTTGTTTAGCCAAT
TGATAAAGGAAAACATAATTTTTACTTGGATCATTTAATTCTTCATCAGTGAAATTAATTGCTCGATCAACAAAA
TGGAATACAAATTCATGTAAATGTTTGACCGCATTTTTAAATTCTGGTGGATTCACCAAAAAGGAAAAATAACCA
AATACTAATCTTTTCGTCATATGATATTGCATAACATCAAAATTAGGTGCAAATTTTGATTTTTCTTCTTCACTC
ATGGTAGAAATTGATGTTTCACCAAGAATCAGTTTTAAACAATCACAACTTTCTCCAAATAAAAAATCTGTAGCA
TAATCAATAGTAAAACAATGGAATAAATGTTGTAAATCAAATTCTCCTTCTCCTTGTTGTTGAAGTTTAATCACT
TTAATTAACAGTTGAATATATGATTCCATAGCCGTGATTTGTTAATATGTTCTTTAGCAAAAATTGGTCTCAAC
ATAATTCGACTATGTTTCCAACTTTCTCCTTCACTTGAAAAAATCCCATTACCTAATAATGGTTTTAAAGCAATT
GGTCTAGTACCAATGGTCCAATTATTCAAATCAGCACTACTACACATGGTCCGGAAATTTTCTGGTTCAATAGTA
ATGATTTGATTTTTCCCTAAAGCAGTAGTTTTCATTGTTGTTGTATCAAGATTATCAAGTTTCCGTTGAATATCT
TGATAAAAATATCCACTTTTGGTTAGATTACTATTATCAACAAGGGCTTTAATCCCAAATATATCATACCATGTA
ACTAATGGTGCTTGTTTTACTGGTTGACAATCATATTTACGTTTTATTGATTCTCTTTTCCAATATTCAGCAATA
TAATAAATGCTGGCTGCTATAACAGCAATAGGTAATAAAATTAACATTTAATAATTTAGGGGAGTGGGGGGTAG
AAATTATTCAATGTAAGGATGTTTTATATGAAATAAAAAGAAATGAGAGATATGAATGAATAAAATTCTTTCTTG
ATTTAAAATAATTTGAAGAAATTCAATTTGATTTAAATAGTTGACAGCTAGTAGTAGTGAATGATATGAATGAAT
```

```
ATACTTTTAGGAAAAAGGATAGAAGGAGGTTGGTGGGGAGACGTTGATTCAAAATTGTGTTTAATAAAGTTTGAA
TAGTTTATTCTCATTACCATAATAATAATGAAAACAATAGTGATAAAATATATATGAAGACATGGTTTTTTTTTA
TATTCTTTCTCCTCCACTTTCAATTGAGTTATAATAGTTGACTGTTGACTAGTTGATAATTATATTGATAAATTG
AAAAAAAAAAAAAAAAATTTCACGTGGTGATGATTTCATCTAAATGTATGCGGAGATTGGAGAAATGCGAGGGGA
AAGGAAAGATTACTACTAGTAGTAGTTGTTTAACTGACTAACTAACAACTGGAGTGTGGAGTAAAGAAACAACTA
AGAAAAAAAAAAAACAAAACAAAACAAGAAGATCGTTGAGTTGCTCGGAGTTATTGCAAAAAAAAATTTGCAACT
AATATTATCTTCGGAGTTAATTTCTTCTCCTTCCAATATTAATGCCATGTCATATTAATTGTCATTTGTTATAAA
TAAAATTAAAAGATGTAAAACGTGTGTGTATGGAGCATTTGAATGTGATATTTCTTTCAACGTGTATCAAGTTAA
CAGAAGAATAACAACAACAACAGCAACAACAATGAACAACGTTTTATTCTGTTTTGACTGTACAACTGATTGATA
TTCAACTTTAAAAAAAAAACGAATTGACATGAAAAAATAACGCATACACATACTATTGTTGATAGTGTTAAAGGA
GGAAGAACTAACTCTTTTTTTCAGATATTGTTATATAGTTTTTGATGAAAAGTATAATTCTGTTTTGGTTGTTGG
CCACAGTAAGTGCTACGTTGTTTACGAAAATAAGATCAATTCAATGATTCACATTAAGATGGTCCAACATAATAG
TAACGGATTTTACGATGTTTTTGTTTTCTTAGGTTGTTTCGATTCTCAACAAGGACTTTTCAAGTTTGTGATTT
GGTATAATTACTTCTCATCATTTAAACAAATCATATTACCATAGATATATTGCTTCCAAAGTATACCTTTATTCA
AGTAAAGACAAATTAGGTGTTGTTTGTTATTACTTAGATAATTTTGCATCTGAAAATTGTAATCAATAACGATTT
CAACAGGGCTTAGTAAATTATACCATGCAAGTATGTTAGGTTGTTTGTTGTTTTAATTACCTTCTACCAACGTAT
ATAGAACTCTTTTCAAACATATCAAGGCGGGTTTTACTTAAATAATCATTTTGTTAAAATAAGATTAACTGAAAC
AAAAAAGTCTAAAACAAGGGGAGTCTATTGTTGTTTTCCCTTATTTTCTGGAACTCTGTATTATTTATTTTAAAC
TTCTTGGGTTTTTCTTTTTTTTTTTTTTGCAACATTTACACTTTCCATGGGTCTAAAAAAAACGTTTTTTTCCA
TGTTTTTATTTCAACATGACAATCACAAACAAAAACAGTGTTACCAAAGAGTCAATTTGGAATATGTGTGTTGAA
ATTGTTTATTCATTGTATTATTATCATCTGCATGTGCTGTTGATGTTGATGTTGGTGATTGTGAGTGTGGTTTGA
TTTGAAGTTCCGTTGTACCTTGTTTTTGGAAAAATAAGCTCTTCTATAAAGTGACAATATTTGTACCTCTTATTT
TACTAATGATATTGTGGCCATTTCCTCGAAACCAAGAGTATGCTAAAAAAGTTAAACCTGGTTATGTGATGACTT
GATCGAAGTATAGAATTTGCAGCTTTAAAAAATAGTTTTAGAATGCAACTCTTGGCAATTGATCATTTGGTAGTT
TCTCTGTCCATGAGCAACATTTTCTATCAAATAAGTTTCGTTGAAAAGTCAATATCAGTATTCTTATACATAAAG
TATCAAAGCCACAATTATAGTTAAATCCATAAGCGTTGTTGTTGTTGTTCCCTTTACATTTGTGATCAAACAATG
ACGACAAATTAAAGTTCATGTTTTTTTTTTTTTCGTAATGTAAACAAATTGTTCAAATTCAAAACAACACCAC
ACACAAAGTATCTATATCTATGATTGAAGATCATTGTTACAATATATTCACTCCCCTCGTACATGTACGGCACAA
ATTATATATGAGCAGTTATCAGTTGTCTGTGATGCATGTGCAATGTATCAACAAATAGTGTGGTTGTTGTTTATG
TGCTATTCCCATTCAATATGGTGTCATTGTTTTGCATTTTGTTTGGCTATGTAGGTTTGTATTTGTTCATTTGAT
TAGTACACTCTATTGATCTAAATAAGAGAAGCAAAGTTGTGTAGGAATTAGTCGGTGTTACCTAACACATCGTGC
AAAAGGAAGAACAGAAAAAGTTATATCCGAACATGCATTGTTTGTCTGCAAATCATGTAAATACATTGGGCCATG
ATGAAAAATGAAGAATAACTTCTGGTTAATGCAAAAAAAAAAAATAAGTGTCTATATTATTAAAAATTAAGTAAT
TGTTCTATATTATAAATATATATATATGCTTGTAGTTCGTTTTTAAATTTTTTCATCTTTCTTTTCAAGGAGGGT
ATTAATTACATTTGTTTCTCCAAAAAATAATAAACAAATGGGTATTTGGCCTCTCTATTCCAAAACAAAGGCAAA
TTTGGATTTATGACGAAGTGATTTACCATAATAATAGAAAACAAATGGCATTGGCAAAAGTAAAATACCAATACA
CCCTAAAAGTGTACTTGCCCATTTAATTGTTAAATTGGTAAACATTTGTCTGGCAAAAAGTGGGAAAACAGCCCC
AAATGCAGATCTAATAAATGTGTTACCAGCCAAGGCAGTGGCTGCATATAACAAGTAGCAATCAATAATATAATT
GAAACATGGTAAGAAAATCAACATTAACCCATTACCAACAAATGCAGCACCAATGACGGGGACTATCCAATGGAC
ATGTTGTGGGTAATTACCAGTCCAACCAAGCCAGAAAATACCAATAACAAATGTGAATCCACCAACCATCATGGG
TTCTAATCTTTTTTCGGGGATGATTTTACCACCATTATCTTCCATGGCTTTAATGTATCTTTTTTCAAACAACAT
AATCATACCACCACCAATCAAAATCCCAATCAACATGGCCAAATATGGTAATTCAGCTACACCTTGAACAAAATG
ATATTCACCCAAGAAAATCAATGGAATAGCAGTTAAAAACAAATAAAGCATACCATAAATAAAAGCATTATAAAG
ACTGACCAAAAACAAAATTGGTTCGGTGAAAAGCATTTTAAGTGGACGAGCAATATTATTTTCAACAATTTCTTT
CATACTTAATTTCAATTCTTCATGTGGAGCATAAATCCCCCAATTACCTGTTCTTCTTCTTAATTCTTCAGCTCT
ACGTGTTAAAATCAATGGATGATGAGTTTCTTGTAATAAGAATGTATTCATAAATAATGCCAAGGAACCAATAAT
CCCACAGAAATATGAAGTCCATCTCCAACCCAAAGCACTATTTTTCACAGTGAATGCTCCCAAAATTGGTGCAAG
CATAGGTCCACCCAAACAATAACATGGAGAAAATGGCAATTGCCGTACCTCTATAACGATTATTAAACATATCGGC
CATAACGGCAGGAGCCACAACCAATGGAGCAGCACCAATAAACCCAGCAAAGAAACGACAAATCATAATTGTTTG
AATATCTTTAGCAGTTGCCACGGCAAATGAAAAACACACATAACCTAAACATGAAGGAACCATAACTAATTTTCT
ACCAAATAATTCTGATAATGGACCATAAATAACTGGACCCGAAGCAAACCCAAAAACAAACAATGACGTGGTTAA
AGTTGCTGGAGTCCAACCAATATGATAAATTTGCATTATATCAGCACTTGCTTGAGAAAACATTGCTGATCCCAT
GGATACCGATAAGGCAGCAAGACCAACAGATGCACAATATAAAATTTTTTCCAAGTTGGATAATTATGAGGATG
ATCAGGATCATCGGGACCATCAAAGGCAACAACATAAGGATCTCGTGAACCAAGCATTGGAGGATATTCTTTACC
TCCACCCATTGGTGGCAATGGTTTACTCGATTGAGATGCAGTACGTAATAAACTTTCAGTATTCATAATACTTCT
GGTGGCTCTTCTCGATAATTCAGTATTTGATTCTATTCTACTCAATTCATCATCAGGAGGTAATTCACCACCAAC
ATTAGCTTCATAATCTTTGACATTTTGTGCATTAAAACTATTAATTTCATTTTCTTCATCAGCAGTGTTACTACT
GGATTCAACTGAATCAGTAGGTCCAACATAGCTTTGTACATTGACATTATTGTTATTAGTTATATGTTGTAATTC
GTCATTAGAAACGGAAGTTGTAGTATTTTGAGTGATTGTTGCTTCAGGAGCAATATCGTTGTGATTGCTGTTGGT
```

```
ATTGTTATTCATTGTTCTATCAATTTAATAAAAAAGAACTAATGGATAATGAATTTTCCAATTGAATTTAGAAAG
AAGAATAAAAAACCCCGAAGAATTTTTTTTTTTAAATTAATTACGACTATTCGTTTATATATATATATATACT
GTGGGTAAAGGAAAAAAACGGAAAAATAAAAAAATTCATTTTCTTACTGGGGGTTTATAATTCCTAAATAGAAGT
AGTAGTAGCTGTTTTATTTTCCGTGCGATGGGCCGGCCGAAACAAGAAATTCCTTTTTTTGCTTCTGCTTTTGCT
TTTGCTTTTGTTTTGTTTTCATCCTCGCTTGATTAAGTTAATGTTAATGTTAGGAATTAAAATTTTTTCTTTTCC
GCCCTCCCGTTTGTGTGATTTTCTATTAGTTGTTGTCGTTTAAATCCGATGTGCTAAAAAATTTTATACTAAAAC
AATTACTAGTAAGATGTTATTTCTTTTTATTTTATTTCATTCTACTTAGTTGTTCACTTTCTGTTATATAAATTG
TTAGGTTGAGAGTCGGGTTAGTAGCAAAAAGGGCTGAGCTTCATCCTTCATACAATACACAAAATTACAAACCAC
ACCGGAGATATTATTGAACATATTTTTCATATTAAATCCGAATAGATGAATTAGTAATCAGCATCATTATCACCT
TTTGTTACCACACCAGTTTGATTTTGACAGTATATCCAAATACTTCTATTTCAACTGTTTCGGATAAACTCTAAA
AGCATAAAACATACATCAAGGTTTTTGGAAAACTATTTGCACCAAAAGTTTAATCAACAATTGTAATTCTCAATT
AACTATTAGTAATATCATCTAATAATATCATCTAAAGAAGAAAGCTATAACTAACCTAATTTTCATTGGTCCTTC
TCCTTCTTTTATCTTATCAGACGTCAAGGTTTAGTGAAAAATTATGATTAAATAAGTTACAAATTATTCGTCAAC
CAACCAACACGCATGCACACATCTAAACTAAACATCGGCTATTAATTTGCTTTTTTCAGTAATATCGGCAATTAA
ATATTTGGCATATACACGACTAGCATTGTCATGTACAAAAATTAGTTTCTGTTTAATTTAGCTTGATATATTCAA
GTCAAGATTTAATGTGTGATATATGATTTCCCCAAAGGCTATGTCATTTGATGAAATTTTATTGGGGTCGGTGT
TTATATCCTTGCGGAGTTTAGTATACGAAATAGAATGAGGGGATTTTATTTATTTTCTCTTCTATTGTTGTTCTC
AATGCATTAACTTATTAACCCTGTAGCCGTGTTGTTAAGCCGATTGTTTCTATTTTCGTATTATTTGCGCTCAT
CACAAAGTATATAACTCCAGACATTGTTTGTAATACCTCCGTAGTAATAATAGTAAAGAACCAACCAACCAGCCA
ACCAACTAGAAAGTGACAGAAAACTTCACTCCAACAAAAAGGATGGAGTAACAATGAGATTCCCTCCCCCCCCAA
AAAAAAAAGGTTAAAAGCCTACCTGGCTACTAACTTTAATAATACAAAGATTGCTTGTCACTTTATCCTGGAAAG
ACTTTCTATATTTGGCTGTGGAGAAAGAAAAAAAGTAAAAATAAAGAAATGTCTAGCATTTAAATAACGTACATA
CATATTTATATATATATATATCTAAAAAATCTAGAAAATCAATCAATCAATTAATTGTCTTAAATGAAATATAAA
CTTTTTTGAAATAAAACGAACAAAAAAAATAATAAATAAATATAATTGTAGTCGTAATAGTAGTAGTAGTAGTAG
TAATGTCATATATGTACGATATAATGTGAATATCCCCATTTAAACAACTCTTTGTTTACTTGGTTCAAACGGAAG
GGCCAAGGCAACAATCCCAATGACACCAACTAAAGCACCACAAATCCAAATTGGTACTGCCGATGAAGTATCAGA
ATACCAAGCAATAATGGGGACCATTGCGGTAGAGATTCTTGTGAAAAACAAACATAAACAATTCCCAGTGGCTCT
AGCAGCTGATGGCATAACTTCTGGGGTATAAGCATACATAACCCCATAATATATATACAAGGCACAATAAACTGC
TGATGTTAATCCAACATTTTGAGCTCTGGTTCTCACGGCAGTATAACCAAATAATAATGCCATGGTAGTGACTCC
ACCAATAAACAATACCCCCTTTCTACCTAAAACTGGTAATAAATATAATAATAACCCAGCAATAATGGGACCACC
AACTGAACTCACATTAGAAATGACTAAATCTCGATATACTCCACTAGTGGTATCAGCAGAGATATTGGCACCACG
AGTAGCTAAATATTCTGGTAAAAACGCTGAATATAATGGATAAGCAATACCTAAACAAGCCCATGAGAAAAACAA
CAAGGAAGTTGACCAAGCTGATTTTTTGGTTGCAAACAAAATTTTCAAATGTTGAAACATTAATGACAATGTCC
ACCAAAACTGAAATGTTTCCTATAGTCATCATTACTTTCAATTTCACCACATTCTAACAATTGTTCCAACGTTAG
TGAACATTTACGATTGTATTTGTGGGCAATTTCTTGTAATACTTCAACTGCTTCAGCATCACGATTATTAGCCAC
CAAGAATTTAGGAGTTTCTTTCAATCTCACCACTGTGAGTCTTAGTATGGCCATGGCCAAAACAATTGATCCATT
AGTATAAAACACATATCTCCAACCACGATTGATATGAGATGGACAATAATCAGCTGATTCACAACTATTATTTGG
TAAAAATGCATAAGCTAATGCAACAGCAATAGTTTGACCAATCCCCCAAAAGAATGCGAAAAAAGTTAATAACCA
TTGATCTTTATGAGGTAAATATTCCAAAAAGACACAAGTATCCAAAACTAAATTCCCACCAGCAGCAAATGAACT
TAATAATACAAATAAACAATAAGATGCCATATTGCCCATCATCCCCGTCATGATTGTGAAAATAGCACTTAATAA
TAATGATAAATTGAAAGCTAATCGTCTACCAATTAAATCAGCTCCAAACCCCCATACTAATGCTCCTAAAATCAT
CCCACCGGCATAACATTCATTACTAACGGGGAATTTATAACCAAATTGATAATTTATAAATGTACGGACACTACT
TTCAAGATAAGTCAACATACAATCAGTACAATAACCCATACCATTCAAGAAAAATAATTTCAAATGATAAGGAGT
AAACCCAATTTCATCAATGGCATCATTAATTAATTTCATTTTATTATGTAATATGGTATCATTAGCTTCTAAACC
AACCATATCAAATTCCAGCGATGTGGAATCTTCTAAATAGTTTTCCTTATGAGAAATGAAATCCTTCTTATCATC
ATTTCCATCATTGTTGATAGAATGGTTAGAGTGGTTTTGGTTTTGGTTTTGGTTTTGGTCCTCGCCCAAGTTTTG
GTCTGGGGTAGTATTCTTTTCAAATAATGACATGATTAAGCAACTAAGTAATTAAGTGAATGAATAGCTGAATAT
GTCAAAATTAAAAGAAAAAATGAAAAAGAAAGGTATAAGTAATATAAATAGGAACTTTTGATAGTTGAAAAAAGG
AAAAAAGGAAAAAAAATCAGGGGAAAAAGGGAAAAAACCGAAGAGTTAAATAATTAATTCTTTGTTACTTGATT
TTGGTTTTGTGGGAGTGAAAAAGAAGAAGAAAAAAAAAAAAATTTTTCTTGTTAGTATTTTAATTAACTATTGAC
AAGAAAACTAAAATATGAAATATACTAATAAAGTACGAACCAACCAATTATTTGAAAAGCAATTATATATTGGTT
AAAATTAAACTTTTGAATTGATTAGCAATCAATTAAAAATGAAAACCACCAATAAACTTTCAGGATCAGAACGAA
AGAAAGAAAGATCACGAAAAAATTTTTCAGTATTAAAAATAATATTAATTCATTGATTCATACATTCATTCATTT
GTACATGCATGAATGCACCATCCACCCACTCACTCACTCACCGCACAAAAGTCTAAATTGGCAGAGAGTTG
TGACTAAGTACTACATTCTCCACAAAATGTATAACCTTAACCATAACCAACAACAAGGAATTAAATATGTAGTTA
TATTTCCTAGTATTATAAAACCTCTATAGTAGTTTTTTGAAAGACACAGATGGTTGGTTAGTTACAATTATCAAC
AGTCTTAATCAAGTGTAAAATAGTACTTGCGAGAGAGGGGGGGGGGGGGGAAGAAGTTAGACAAGAAGTACAGCC
TTTGGAATTATTATTATCATTTTTTTAATAACCTTCTCTCCCCTATACGGTTTAACCCACAAAATCATATCATTA
```

```
TTACATCGTACTAGTATACTTTATTTATGGGATGACAATTTGATTTTTTTTGATCATGAAACAACGACAACAAT
CAATCAATCAGTAGTTCCAAGAAATTCACAAAATCAAGAATCGTGCAACATGGTATAGTAACAAAAATTGACAAT
AGCAACAATTGCAAAGCAAAGCAAAAAAAAAAAAGAACTGTCTTTCGTATTTAAAAGGCTATTGTTATTCAAAGG
TAATCTTTTTGGATATTATATCTTGTTAAAAAGGAAATTAACCCCAAGTTTTCACCACCACCACAAAGATTTAGT
TCATGGGTCCAAATTTATTATTATCTAGAAGAAGAGTGATTTTGTGGGGGGGGGGGAGAAAATTATGGTAGAAG
ACTTCTAACTTAGGGGGTCTTTTGATTCTAGAAGAAATACCCCAAGAAGAAAAATAATATGCATAAATTGCACGC
ATGACCATTTGTGGTAGTAGCCAGTTCTTAGGGAGGAGGGGAGCGGTGTGACAAGAAATGAATTTTGGGCGACT
GTACGCCGGGAAGTGCCGAGACTTTCCTTTCTTTACTTCACTTTACCTCCCATTCGCATATGCAATAAGATAAAA
TATAACACTTTAAGAAATCGATTTGACAATCTGTCTAGATCAGACCAAGAGAATTAACAAAATGTCCTTGTTACT
GTTCTAACACTACTCTGTTAGCCACATGAGTAAGATACACCTTTACTTTATGTGTATTTGGCTAATTAGTGTAGA
CCCTGAACCATTTTTTTTTTTCGGTGATTTTTTGTAGATATTTCTCCTATAAAAAAAAAATGTCTTGGTATTTCA
TTGCTGATAAATATTATTGCCATAGAATAGAAACTTATCTAGCCAATAAGATTAAGCTACTATAGCGTTGAGGGT
TGGCTTAACCCCCTCACAGAAACTATAGAAGTTTTAAAATTAAACTTTTATTTTAAATCTGTGGCTAGTGTTGTG
GTAAAGTACCTTGACTATTGAAATGAGTCTACATTTTGAAACACTGTGCTGTGATGTGATGGATTTTTGTATATT
TATGAATACAACCAGGTATAAATATATATATATATAAAACACAAACAAACACTATTCATAATCATCGATATATTT
TTGTCTCATTTCCATTACTTTAGTAAATAATGAATTTTTTGAATCACCACTATCTAAACGAATAATTATATCATC
AACATCCCAATTTTTCGATAAATAAATTTCAATTTGTTCATTAATTTGAATTAATTTATTATATAAATTCAAATT
TTGATTAATTAAATCAGGAGTTAATTTAGGAATTTTCGAATTTTGTAATAAAAATTCACCACCGGTATTATTAAA
AATATTAATAATTAAAGAAATATAATTTAATAATTGATTTATTGCTGGACCAAATTTCATATTTAATTCTGATAA
ATTAATTGGATCAACACATAAATCTTTAGTTTTAGAACGTAAATGATATTTTATAGGATTAGTTTCAATTTCATG
ACATAAATTATATAACCAATCCAATTCAATATTTGTTGTTGTAGGAATCAATTTTGAAAATTCCCAATCGGCCAA
AATATCAATACTTTTACGGATTAATGAATATTTCGAAGTACCACTAGGATATCGATCATATACATTTAATTTCAA
TTCTTCCATTGGATCAGGGAAATTATCAAAACATTTTTTCAATTCATCATCAATTTTAATATTAGGTACATCCAA
TTTATATAAAATCCCCTTTATATTCCCCCAATGTACACAACTTTTCAAAGCTACTAATACATCATGGGATAATAA
TGCCTCTTCTCCATAATAAGATTCAATGAAATATTTCATATAATAACCTTCTAATTTTGTTCCAATATGATGATC
AGTATGTAAAAAATTCAATTTTGAAGCAATCATTAAATTAACCCCCCATTCAATATGATGATTTCAATAGGATG
ACATTGAATATAATCATCAGCTAAATCTTTTAAATCTCTTGGATCATATTTAGCATTTTTAAAATGAATAATTGA
AGAATTTTCAACTTCATACCATTTATTTTCTCTAATTCTAATGCTAAACTTAATATTGTACAACAAAATGATGG
GAATTGTTGTAAAATTTCTCCTTCACCAATATTATATAATATAGTAAATGCTGAATAAAATGATAATTTTTCATT
TAAATCTTCAGGATAAATAATTAAATGTTTATCTTCTTGCAGAATCCTTTGGAATGTATTATTAACAAATCGATA
TTTCCTACCCTTTTTATTATATTCAACTTTTTGTAAATTATCAATTTTGATGTAAAATATGATCTGAAAATGTAAT
TAATGCATCTGATGTCGACATTAACGTGGTAGGGTGAGTTGTTGTAGGGGTAGCCATAACTGTGGGGGTAGCAGT
TGCAGTAGTCATATCTCACTAACAAGCTAAGCTAGTTGAAAGAGTTTAACCAGATCAAGGGTAGTAGTAGTAGTT
TATTAATAAATTGATGTGTGTCAATTTTTTTTTTTTTGGGTTTGTTTTTGTTTTTGATTTTGATTCCAGGGTCA
GGCAGTCAGTTAGTTAATTGTCGTGTTAGAGAATAGAATTTAGACGAGCAAAAAATAAAGAAGAACTTGACACCA
TCCCGTCCGCGTCTAAAACAAAAAAAAAAAAAGAATACTCGGAAAGAATAATACTTCTTCAGTCTATATCTATAC
CAAGTACCAAACAACATCTCTTCCTACGTATTATGATATACACATAAGTATAGTATATATTGAACAATATTGATA
CATAAAAACATAATAAACACACAAAACTTTTAAACTTTTTCTAATAGTACATAACTGGGACAAAAAAAAAACAAG
TCTAATAACTCCACAACTCCCATCATTCTTCTAACTTGTATTGGGGAAAACAATAATCTAGCTAATAATTCCTTT
TAATGGTCATTCGCATAACCGCCCTATCATTATAACATTTCTTCATCGATATTAAAACTAGAATCAATTTCATCT
TCTAATTTTACAGTATCATCAGTCATTCCAAAATAGTTTTCGTGTTCTGGCACAAAACAATCGCGTTGTTGGTGA
AATTGTTGATGCTGCTGCTGCTGTTGTTGTGGTTGTTGTTGTTGTTGTTGTCTATAACCATCCACAACG
TACCCTTCAACTTCACTTTCTGGACTAATTATCAATCCACTCAAATTTCTATTCCCATTATGAGGTGTATGTATT
ATATTATCTTGTCCAGCATTATGATATATTGATTGTGGAGTATTTGGAGTTTGATATAATTTTTCAATTGATTCC
AGTTTAAATGAATAATCTTCTAAACTACAATCTTCAAATTTTGTTATTGTTTCATTAGTTTTAGGGTCAACAAAT
TGTCTTAATGTACCCCAAGGAGTGATTTTTATTATACCACCATCGGGATGAATGAATTGTGGCCATTCAGTTTCC
GAAGTAATTTGATCAGGTTTAGTTAAATTTTTCACTATACGTTCATCATCAATATAATGTTCATAATTGTTGGCA
TTGGCATTGGTATTGGTATCATCATGAAAGGTTAAACTGTTTTTCCGTTTATTATTATGAGGGAAACAATTAGTA
GTATTAGTACTAGAAGGAGCAGGTGATGGTAATCTATAAGCAACCATAGGTAACAGTTAATTTAATTGTTGTTAT
GGGGTAGGAAGTGGGTATTAAAGTATTGAATAAACTAAAAGAAAAGAAAAGAAAAGTAAGAAAGAAAGAAAGAT
GTGAAAAAAAAAAAAAGAGAGAGAGAGAGCGAAGATTAAAATTTTGTTCACTTTGTGTGGGAGGAAAGAAAA
AGGAGTGTTGCAAGATTAAAAATTCTTCTTTAGTTAAGTAGTAGTAGTATTATCACCGCTGCTACCAAACGTATA
CATTGTGTGTAGTAATATGTGTGCTGCGAATTTTAGAGTCTCAGAACTTGAAAAAAAAAAGAAACAAGAAATTT
CAAATTCCATCTGCTGATAGAAGACGAATTTACCACAAATATTATTAAACGCGTACTGACTAGTAGTATTTACTT
AATATTCATTCAACTTATTGTATATGCAATGCTGGTAGTGTTTATTATTTGTTTAATTTTAATTTGACGCGTGA
TTATTGAACGGTACTCGTATTAATCAACTTTAGCCAGCCGCCCCCCAATTATCTCAAGAAACTTCCCCATCTTA
CCACCTAACTAACTAACGCGACCTGTAATTCGTGCACGACTTTTATTTTCTTTTTTCTTTGGTTTCAAACAACAG
GCATGTACACATGTACACGACTAAATTTTAACACTCACACGACCATGAGCAAATTTCAAGTTTCCCTTCAATTTT
ACAACCAATGGCATTAACGACAACTTGCAAATTCATATTAATCTATACTGGTTTTACCTATGTTATCTATTTAAC
```

```
CAGACATTAATCACTATCTTCATCAACACCAAAATCAGTTAACCCTTCTCCCATATCATTAATGAAATCTGAACG
TTGAACATTCAATCTAGGATCTAATCTTCTTCTCAATTCTTGATAATTTCTAATACTACGTAGTTCTTCCTCGTC
TTCCTCTTCCCTATCACGCTGATATCCTTGTTGTTGTAGCACATTAATTTCAATTTCTTTTTGTCTAATACCATC
AGGAGGCCAAGGTAAATTCAATTGATCATCTTGTTTATAATCTTGGGAAATTTGTGGTTGATATCCATTACTCTT
AGGTTTACCGAATGGTATTAACCACATATAAGGATAACCCAAGCATTTACTAAATTCTTCCATATTCCTAAATT
ATAAGGAAATATCAAATCATCAATAGTGAAATTTTGTGGCACTATTGTTGAATCTTCATTATTATTGGTTGCTAA
ATTAATTAATTCAACATCCTCATCCCCATCATCATCATTATCGTTATAATTGACATTATTGGTGGTATTAGTCCA
GGTGTTCAATTCAGGAAATGGTTTACCTTTATGTAATCTTCCATAATTGAATCGAATCAATCTCCATAATCGTTT
ACTTGACCATTGAAGTTCTAATCTTTCCCATTCCCATATTTCTATTTGTGTCATCCCCTTACATATATTAATCAA
ACATCGAATGAACAACACCAATATACTAGCAAAGACAAAAAAATTTAATGGAGTAATAGCAATTATGGCCACTAA
TTCTGTCTTGTTGAATAAATAGTGTGGCATATTCAGATTTTCATAATAATTAATAATTAGTTTAATCAATTGAAT
CATTAAATATCCTGTACCCCAAATGATCCATCCAAGAAATCTCATGAAATGAGGTAAATTATTATTTCCAACACA
ATTCAATGTCCAAGGGCAATGATGATCCATTTGTAAAACACATTGTTGACAAATTTTACAATGATGACTTCTTGG
TGGTTTATAATTATTACATTTCTTACAATACCTTATCCATTCACATCTATCTCCACTGATTGGTTCCTCCCTTAT
TAGGGTTTCATCTTCTCTAGATTCTAGACCTAACCCATCAGAATCATCCTCGGTTTGTTCAATTCTTGTAGACGA
CGCCAAAGATGGTTTATAATTTTTTGGGACTCGTCCGGGATTGGTATATATTGCCAATAAATAAGATATCCATAT
CATAGTCACATAAAATTCATAAATCAATTGTTGTTTCATTGTTAAATGGTGTCGAAGAATAAAATAATGTGATCC
ATAAGATAATGAAAAAATGATTATACAAGGAATAATCACTCCCAATATGGGCCATTTTAACTGTACTGCCATGAT
TATTCAGTAAAAGTATTGTTTACCATCTAATTATGAAAACTATTCAACCTAGCAGTTGTTGTATAGATTGAACTG
TGGTTGTACTAATAGTTATTTAGTTAATCTTTAGGAGAAAGTGAGAGAGAAATCAGAGAGAAATTGAATCAACGA
ACTGAACCATAAAAAAAAAAAAAAACCTTTGAAAAATAATCTCAGTGGCAATATCAACAAACTTACTCTCTTCTT
CTTTTGTAATCATTACAACAATTCTTTATATAACTAATATTTTATCTATATCATGGTATGTCAATTTGTTACAACT
AAACACAATGCATTGCTCATGTATACTAACTGATTTATAGACTTCAATTGGTACAGGTTACGATTTATCCAACAG
TGTTTTCTCACCAGGTATGTAATCAAATCAAATTAAATATTATTATTTTTTGCCCTATCCTGTTATTGCAGTATA
CTAACTATATATAGATGGGAGAAATTTTCAAGTTGAATATGCCATGAAAGCCGTTGAAAATGGTGGTACATCAAT
TGGTATTAAATGTAAAGATGGGATAGTATTGGCTGTGGAAAAAATCATTCAATCAAAATTATTAATCCCCAAGAA
AAACAAACGAATTCAAACTGTTGATAGAAACATTGGAGTAGTTTATTCGGGTTTGTTACCCGATGGACGTCATTT
TGTTAATAGATGTCGTGATGAATGTCAATCATTCAAATCAATTTTCAAAACTATGATGCCAATATCTAATTTAAT
GGATAGAATGGGTATTTATGTTCAAAATTATACTTGTTATAATTCAGTTCGTCCATTTGGTATAGTATCTATTAT
TGGTGGAGTAGATAATGAAGATGGGGAACCATACTTGTATATGATTGAACCTAGTGGTAGTTATTGGGGGTATAA
TGGTGCTGCCACTGGTAAAGGTCGACAAATTGCCAAATCAGAATTAGAAAAATTGAAAAATTGAATTATGAAGAATTGACCTG
TTTAGAAGCAATAAATCATGCTGCAAGAATTATTCATTTGAGTCATGAAGATAATAAAGATAAAGACTATGAATT
GGAAATTTCTTGGTGTAGTAAAGAACACACTGGAGGTAAACATCAATTTATTTCTGATGATTTATTAGAACAAGC
TAGAAAACTTGCTGAAGAAGAGGAAGAAGAAGAAGATGATGATGAAGAAGAAGAAGCTGGTGCTGATGATGAAGA
AATGGCTCCATAATGTGAATATATAGGTTCAAATTTTGTTTTGAATGAAAACAAAAAAGAAAAGAGAGAATGAAT
TATTATTAACTTACTAGATACAATTAAATAGAAATACAAACTATCAATTTGTTGTTTCAAAGTTGTTCCATGTTA
ATTGTATGAGTGTAAGAAAGGGGGGGGGAGTGTGTATGTCGTGGTCCCCTTGAGCAAAAAAAAAAAAAAATATTT
TCTGAACGTGTAAAAAAGTAAACAAATCAATTTGATAGTAAAAGAAAGAAGTTAACAACCAAGTCATACCTTACC
AAATCAAACGTCTATATGTGGAATAGACAACTAATTTTTTATTTTGAAACATTTTTAAAACATTATTAGTACCTT
GAAAGCTTTTTATTTTCCATGTCAAATTTATCAATTAATGAATCAAATGATAATTCAAATGTATCCATTTTACTG
AATAAAAGTGGTGCTCAAAGTAGTACTAATAGTAGTCCTAATCTTATTGTTTTTAAACAACCTGAAGATTTATCA
ATTCAATTACAACAACAACAACAAGGAACTCAAGAAGATACACCAGAAGAAGAAGAAGAAGAAGAAGAAGAGATG
GAACAAATAACGCAATTGGAAGTTCAACAAGAAAACCAACCAGACACTTTATCTTCTAGTCCATTTATTTCACGT
CCGAATTCACCCCTTGATGATATAATTAGACCCCAAGGCACATCTTCACCATCATTGACTATTAGAGATTCTTAT
TCTTCTCAAGTAGATATCAATATATCTAATTTACACAAGAGTTTGAATGAGATGAGATTATCAACTGATCCAGTT
GACAACAACAACAATAACAACAAAGTCAACAAAAACAACCCTACCAATAGTGATATATCTAATGATGATATCATA
ACCATCGATAATTTGACTCCAAGTAGAATACAACCAAAAACATATCGCCATGGAGACAATTCCGCCCTACGTTA
CGTGGTAGTCCAGAATCAACGCCACGGCTGTTGTTTCAAAATAAACCCAATTTGAAATTTAATAATGGTCTTAGT
CCTACTAATGGTAGTAGAGATATGGTTACAAATAATATTGCTACAACAACCAAATCAAGAGAAGAAGAATTGAAT
AAACGAATAGTTAATTATAAAATCCAATTAAAATTGATGAAGAATTTTTTACAAGAATTGATTGATAGAAATAAT
CTTGATCCTCATGAATTTCACACATTATTAAGAAGCAACAATAACAACATCATGAATAACGAAAACAACCCATTA
TCAACCTCATTGTCGCAAACTTCAACTTTAGAAATTCAACATCAAAATTTACAAATTGAACTAGATGAAGCACTT
GAATTAAATAAACAATTGTACAACAAAATAGAAACTGCAAATAAGGAAATCAGTGATAAGGATTTGCAAATTTCT
AATTATGAATCAAGAATCAATTTAATTAATTATTCTGTTGATGAATTAATTTATATTTTGATCAATGAATATGAT
AAAAATAATTATTCCCACGGCGGCAGCAACACCACTAGCCCGGGTAAAGAAACTTTACAACAATCCATATCGGCA
CAATTAGAAGTTAAATTGAATGTTTTGAAATTAGAATTGATGACTAGATTGGATCAACTGCATCAATATAATAAT
AAACCACATGATTTATTTACTCCACCATACACATCATCTGAATATGGTGTTAGCACCAACAATGTCGCTAATAAG
AATGATTTGGAAGGATATATTCATATTATCGAAGATTTGATTAAAACGGTTGATGAATTGGAATTAACTTGTGAA
AATTACAAGGCAAATAAGAATGAATTACAAAATCAATTAGTTGAACAAATAAATGAATCGATTCGAATTAAAAAT
```

```
AATTTCCAAATTATGTCCAATAAATTTAATCAATTACGTCAATCATTGAGTGAGAAAGAAAATGACAAGAATCTA
GATGAATTTAGTAAAAACAATCACCAGCAACAACAACAACAACAAATACAACAACTTGAGCAAAAATTGATTGAG
TATGAAAAATGTATTACAATATTACAAGATGAATTAGATCAATACAAGCAACCTTCCGATACCACCAATACTACG
AACAACAACAACAATAACAATAACAATAATAACAGATCGTCATATTCATCGTACAATAATCATCGCAATAGTTCA
TTGAATGAATTGATTTAGTGAATGATTATTTACAATTACAAACATCGTATAGTAGAATCAATGATGAATTGAAT
CAGGTAAACAATGATTATAAGCTTTTGAATAGTTCAACACTGGAGAAAATCAACAATTTAACATCAAAATTACAA
GAAAAATCAATTGAATTAAGAAATCAAATGGGGTTGAATAATAAATTACAAACAGAATTGAATTTATCATTAGAT
AAACAACGGAAATATAATACTGAAAGGATACAAATGTCGTACACTGTTGATTCATTGCGGAAAGACAATGAGGCA
TTACAATTGAAAGTTAATAAATTGACTGATCTAATGACAATTGATAGAACTAGAGCAGAGAGTAATTCCCAATCT
ACAGCCACATCAACATCAACACCAACTCCACAAACGGCTCCAACTCCAGCCCCATCAGCACTAGCAACCGTAGCA
CGAACTGCCTCAACGACATCATCTTCAACAACAACGGTAAATACTAATACCAAGACAACAAACGAAAACAACAAT
AGCAGTGCTAATATTGAATTGGGAGTGAAGAAAATCTCTATTTTAGAATATCAATACAAAGATTTATTATTATAT
GATACTAATCAATTCAAAAGATTAATTGAAAGTTATAATAAAATAGCTGATGATAAATCTTTATATGATCCAAA
ATGAAATATGAAAAATTATTAAATCATATAACTGATATTAATAATAGTAATGGGATGGGGAAAAATATTGATATT
ATTGAAAATATTACTTATATTAGAGATAAACATAAATCAATATTTGAATATTTTATAAGAGCCACCGATATATTA
ATCAATGATCATATCAAATTGTTATTAAAAGAAAATGATGATTCAATTAAAGTTAAATATACTAAATTAAATGAT
AAATTGAATAAATTGATTAAAGAAAATGAATCATTGAATCGGAATTAGAATTTATGAATCAACAACAACAACAA
CAAAATCAAAATCAAAATACTAATGTTGATGGAGATGATTACGGTAATACTAGTACTAATAACGATCCATTATCT
AAATTAAGAATGAATGATTTAAGAAATAAATGGAAAGCAGAAAGAGAACGAAGAATTTTAGAAGATCAAGAAGCC
AAAAAAAGATTTAAAGAACTAGAATTGGAAATTCAACGATTGAATGAAGTTATTGGTAATAATAATAATAATAAT
AATAATAATAATAAACAAACTACAAATGATAACAACTAAAGGAATCAAGGTCCTATTTTCACCCGACAAAGATA
TTTTAAAGTGAAAACCTACCTATATTAACTTGTATTTGAAAGATTCTTGATATTCAATGATATTGCCTCTCTATG
TATTTGTATTTTTTCTACTATTATGAGTTGAAATTGATAGTATTTATATATGCTTCTATATTTATTAAATGAAAA
TTGTCCTAAAAGATTAAAGAGCCTTGTTGGTGGTGTTGGTGGTGGTGGTGGTGGTGGTAGAGATGAAGTAAAGAA
TCAAAAGTCGTGTCTGATTGATTTGACCACAAGACACGCACACGCACACACACATAAAAAAAAAAATTTGTACG
TAGAGTGAAAATTTTCCTGTCTCTTTTTTTTTTATTGTTTTTGGCTTTTTCAAGTTCATCAACATAGATCATAC
TTTTAAGTAACAACAACAACAATCAACAACAAATCATTTTGAAGATGTCAATTAACGAGGAAGATTATCTTCA
ACTTGAAAAGGAAATCAAATTAGATGACATTGATTTTTCTGATTTAGAAGAAAAATATGAAGTTAATATTGGATT
AGATAATTATATTATTGTTGATGGAGCTCCAATTGCACCAGAAGCTAAAGTTCCAGTTTTAATTAAAGTTTTACG
GAAATTATTTTCTCAAGTTGGGGAAATTGTTGAAGGAGATGAAGGAATTTATATGCCATTAGAAAATGGTAAATC
TAAAGGATATCTTTTCATTCAATTTAAATCAACAGAACTGGCCGATTTAGCCATTAAAAAATTACATGGGAAAAA
ATTGGATCAAAATCATCGATTATTAGTTAATAAATTATCTGATATGGAAAAATATGGTGTTGATGGAGCTGTTAA
TGAAGAATTCATTGAACCAGAAATTGAACCATTTCAAAGTCATGGATATTTGAAATCTTGGTTACAAGATGAACA
AGGTAGAGATCAAATGGTTTTACATTTTAGTGAAACGGTAGGAGTTTATTGGAATAAAAAATCTGCTGATCCAGA
ACCAGTCATTGAACCAAGAAAAGGGTTTACTTCTAAATATGCTAAATTTTCACCAAAAGGGACATATTTATTTTC
AATTCATCCTCAAGGTATTCAATCATGGGGTGGAGCTAATTTCAATAGTATTAAAAGATTTTTCCATCAACAAGT
TAGATTAGTTGATTTTTCTCCAAATGAAAAGTTTATGGTTACTTTATCACCTATTCCAATTAGTTTACCCGATTC
AACGGTTGATCGTGCTCAATTCCCATTTGGTCCTGAAAGTGAAGGTCATAAATTGGTCATTTGGAATATGATTAC
TGGTGAACCAGTCAGAACATTTGCTTTACCACCTCATTTAGAAGGACAAAAGGAAATGCCGTGGCCATTAGTTAA
ATGGTCTTATGATGATAAATATTGTGCTCGTCAAGGACCAGATGCTTTAGCCATTTATGAAACTGAATCCAATTT
CCAATTATTAGATAAAAAATTGGTTAAAGTTGATGGTATTCAAGATTTCGAATGGGCTCCAGCTGGGGTTAAACT
TCATAATAGTAAAGCTGTTGATGGTAAACATGTTTTGAGTTATTGGACTCCAGAAAGTACTAATCAAACCGCTAG
AGTTGCCTTGATGCAAATTCCTTCGAGAGAAATTTTACGTACTGTCAATTTATTCCAAGTTAGTGATTGTAAAAT
GCATTGGCAATCTAATGGGAAATTATTATGTGTTAAAGTTGATCGTCATACAAAATCAGGTAAAACTATTTTCTC
CAATTTGGAATTTTTCAAAACTAATGAAAGAGATATCCCAGTTGAAAAATTAGAATTAAAAGATGTGGTGGTTAA
TTTTGCTTGGGAACCAAATACTGAAAGATTTATTACTATTAGTAGATTAGATGATGGTAATCCGAATCCTGCTAT
TCCAAAAAATACCATTTCATTCTATGCACCAGAAGTTACCAAAGGTGGAGTTAATCACAATCTGAAAAGAAAGG
TGGTGCCGCCATTGCTGCTGCTGTTGCTGCTGCTGCTATTAATAATCAACTGTCAACTAAATATAAGGCATACAC
CAAAATCGAAAACAAACACTCAAACACTATTTTCTGGTCACCAAAGGGAAGATATGTTGTTGTTGCTACTATTTC
AAGAACTTCTGGTGAATTGGAATTTTTCGATGTTTCATTTGATGATGAAACTAATAAAAAATCATTACCTGCTAA
TGTCAAATTATTAAAGACCGATAAATTTTCTGGAATGACCAATATTTCTTGGGATCCATCAGGTAGATTTGTTGC
TGCTTGGTCAACTTCTTGGTTACATGCCATTGAAAATGGTTATAGACTTTATGAATTCACTGGTAATTTATTAAG
AGATGATTCAATTGATCAATTCAAAGATTTTGTTTGGAGACCAAGACCACCATCTTTATTGACCAATAGTGATAA
AAAGAAGGTCAGATCCAATTTACGTGAATATAGTGCACAATTTGAAGAAGCTGATGCTATGGAAGCTGATGCTGC
TGTTAAAGAAATCATTTTGGCTCGTAGAAAGGCTTTGGAAGAATGGAGAAAGTACCGTGCCAAACATATTAGTAA
ACAAGGTAATTCCAAGAACGAAGTTCAAGCAGAAATTATTGAAGAAATTAAAGAAGAGATTATTGAAGAAAAAGA
AGAAATTGTTGAATAAACGAATTACCGACAAAAGAAAGTTTTTAATCCATAGTTATAATAGTACTTATATATAT
ATATGTATATATATTATTATTATTATTTACATGTATCATTTATAAATTCTATACTTTTTTGGTACGTAATTGTAA
TCCATGCCATTTTTTAATTTCATCTTTTAAAATTTCATTAACTAATCGATGTTGTTTAATCATAGTTAATCCTTT
```

```
GAATTTTTCACTTTCAATAAATATTGAAAACATCGATCCACAACCTCCTGATACATCTTTAATTTTTAAATTCAC
TGGATTCAATTCTTGTTGTAAAATATTATAAATTTTCAGTTCATATTCATCCATTGGTTCTGATTCTTCTTGAGG
AGTCGAATAGTTACGTTTCGATGACAAAAACGGCGATATGGTTCTTTGATTAATACTGCTGTTATACTTGTAGAT
ATTACTCAAACGAATATTTCTTATTATATTATTTCTAATCATGATGGCAATAAAAAACTGAATAGGTAAATTGAG
AATAAATGGAAAGAGTTATTGGTTATCTCTTCATCGATTCATGCAAAAAGTTTTATTGATTCTGAATTCAATTGA
AGAATTTTTTTTTTTTTTGTTTGTTTGTTTGTTTGTTCCAAGCTGACAAATAAAATGTCGTGTATTAAA
AATCTTCTTAAATAAAACAGTTGCGAATGGAAATGACTTGATTCAATGCAACATATAATTAATAGTGTTGATATA
TAACTTAATGGACAATGGCATGGAACAGAACATATCTACTTAACTGTCAGTGGGGTGTAATTGATTTGGAAACTA
CCTCATGAAAGAGTTAGAAGTAATTTTGATAACTCATAGGACAAGAACAACAGTGGTGTCCAATAAGACACGATA
TTTATTTATCCAACCTAATGAATAATTAACTTATGGACTGGTGCTCCTTTTATTGAAAAGTCCATTTTGGGACAG
TGATAAGCCAATGTCATAAAACAGTGAGGGAATTTTACATTGTATGGTTTAAAGCCAGACATATATTTATCATCAT
CGGTAAATAAATCACCGAGACCAACAAAAAAAAAACTCCCCAGAAAACAAATATAATAGTTAACGTCCTTATTGT
TTGAATTCAAAAGTATATGTTTATTAACAATCATGCCTCCTATTTCCGACATTAATGTTATAGTAAATTATCTTT
CCTAGCCAAAATTCTTTAACCCCACAAACACAAATAATTATGAACCCGATGATCGAGAAGAAAAGTGATTGTTTT
ATTTCCGCATCAATTAAAAGTCATGTAAAATTCAAAGATAATTTATTGATCAATTACTTGAAAGATCGATCTCG
AGACAGGGAGAACCATTCATTGATGACCAGTTATATTGGTATTACTGATGCCAACAAAGCCATTCTGAACTGAAG
CCCCGAAACAAGGGTCACACGAAATATGTATATTTCTTTGAAAGAAGGGACGAGATATTTATGCTTAAGAATGAG
ATAGAGGAAAACAAATAAGCGATTAAATGTAAAACTGATGAACCATAACCCCAAGTAGCATAAGGATATGTATAG
AAAAAAGCCTACAATTACTGATCAGGTGTAGATTAAGCCACTATGTATTAAGAGCAAACTGATTAAATATGATCA
ATCTAAACAGTAGCTCATCCATCCTTAAAGACTACTCTCGGTTGAAAATACCGATTGATCACAATGCATCGTTTC
CGAAAACCGGTTTCTTTTTTTTTAAAAAAAAAAAAAAGATTTAAAGCAAACACATAATATATGGCGGATTAGAAA
ATTTATCTCCGAAGAAAACTCTTTGCACGGGGATACTAAAAAAAAAAACGGCTCGGAGATATTATCAAGACGGTT
AAATTCATTGCCACAAAAAAAAAAAGCGCATACTTATTATTTGTCAATCATTCCCAATAAGGAAAGACCGAAAAA
TTCAATTCTACCATTTAATACTTTTCAAAATGATGAAAGAAATAGTCCATACAATCAAATCACATAGGTCAAATT
ATCCTAAAGTCTTTTTATTTAAGATAAGCAGTTGATTTAAAAGGTTTCCTCAAGTATGTAGTCCGCACTATTCTT
TTTTTCTTTCTTTTTTTGGTTTCATCGTCCGTCGTCGTCGTCATCGCCACAAAAAAAAAAGGCACTAAACTC
AATGCAAATTAAGTCTAACTCTACATTAGGAATCTTTTTTTTTAACGTTTGACTCAATTAGTATTCTTTTACAAA
TATAGGGAAATACGAAAGGTGTAACTGAGCAAAAAACAGATATATGTAGGGGAATGGGGGGGTGGGGGAAAGGAC
GGATGTTGTTTCAATAGTTAGTCCAACACCAATCAAATAATTTGATATGTCAAACCCAGAGATACATGTATTCTA
ATAAAGTTAATTCAACAAATATGAAAAAAAAGAAGTACTACTGTAAAAATTATATACGGATGTATGTGGATTAGT
TTACGTCAGATCCAAAAGATCATTTATTTAGTAAGGTTATAAAAAGTAGAAAAAGTAATTTTATAATTGCTGTTG
AAGATCAAATTTGCTTTTTTTGTTTGATTTGCGCGTTTCTAAAATCAAGTGGCTCAACAACATCAACAACATCAA
CAACAGCAACAAACAACAAACAACAGCCACAACAAAGAAGAATATTGAGCAACAGAGCAGAACAAAGTTGAAC
AGGTCAAAACTCAACTAAACCAAACTGAATCAAAAATTGATATCATTTGAAAGGAGGAGGGAGGAGCGAGATGTG
TAGTAATGGAAAGGGTGGAACAGCTATATAAACTAAATCCACATCTATATACATATATACATACATGTATAGCTC
CTAAAGTTCTAGAAGAGAATCTAAATTCCAAATTTTAATGAACTATTTTATCAAATTAATCACAAAACACCGATA
GCAATGGAATTCCATTTGCTATTACATAACTCCTCAAGCATAAGCATAAGCATGTATGTATACATACTTCCCTGG
AATATAGATTATGTAATAAATTATAAAATCTCTTTGGTGTGAAAAAGAAAGAGAAGGAATTACCTAGAACAATT
TATCCTAAGATAAGAGTTTATAATGTGTTGATGATTGATTAATAGTTCAACAAAAAAAGGAATCTACAAGACATC
AATTGTAGAGATTTATTTATATGAGTCATACTAAACAGTACATTTAAAAAACTCAATTCAATAAATAACATTTATCGAAT
AAAATTTTTTGGATAGATCTACACACGGCTAATTATAGAGATGGTGATGGTGTACGCATATAACGGATATTTACT
CGATTGGGATATTATGTTTTTGTGTCCGTGTGTATGTGTGTATTAGTCATCGGATATTTGGACTCCAATTAAAAA
AAAAAAAAAAAATCCTAAGCAAATTACACAAACATAACAATCGACCCTCTCTTATTTAATTATAAAAACTGAAAA
GGAGAAAATGATGTAATTGATAGATAAATCTATAATAAATACAAACAGCTTTGAAAGTGGTGGTGGTGGTGGTG
GTGGTGGTAGTGATATCTATAGAACTAACTTGATATTATCATAAACCTTACAGTTTTAGTACTACCACGTGGATT
TTTAAAATCTCAATAGTTTCTATAGTGGTGGTATACCACTACTACGACTGTGGATTCACTCAGAGTAATTCTACT
AATTGATGATAGTTGTTGATAATGTTTAGTGGTACTAGAATCATATGTGATCTATTTAAAGGAGGGAAGGCGAG
TGAGTGAGTGAGTGAGTGAGCGAGTGAGTAAAGTCTATTTTTGATAAAAAAATAACATCCAATAATAACTTAAAT
TTTGATAAAACATATCTTAGTTAGTATCAATTTAGATTATTAGTCAGTATAGCCTCCTTCTCTTCCCACCTTTCT
TTGTACTAACTTTTACACTTTTATAAGTTATACGTAACTTTAAAAAACTCAATTCAATAAATAACATTTATCGAAT
GTTCAAAAAAATAAATAAATAAATAAATAAATACTGCAAACCTTATTCTTTTGTTTCAATGGAACAAACA
AATTTTTGAGGAAAATTAAATTATAATTTATGGGATGATTTTAATGGAATGATTTATATTGAAATTTTAAATTGT
AATATTTTCAACATGGCGATCCGTTAAAGAACTTTTGACAGGGTTATCTACCAAAAACAGTAAAAAAAAAAAAAAA
TTAACCGACCAGACCATACAGTAAGAACTACAAACATGTAATATAACTCTACTAGTAGTATTTTAATTATTGCTA
TGAAGTAATAATAATAATAATATTTCATTGATTATAATATGTCTAGACAAGATGAATCAAACAGACAACTCAAGA
TTCAAAACTAAGGGTTTTTGATTGCAAAGAAGAAGAAGAAGAAAAAAAAAAACAAAAAAGTATACAAACCCAAC
AGCAATCAAATATAACAAAAAAAAAAAAAGAATAGCGTATATCCTTATTATTATTCATTGTAACGACTGTGGTAG
TGGTGGTGAGTTCAAACTTCACTTTAGTTGCGTTTGACGTCACAATCTAAAAAAAAAATAAAAATTAAATCTAT
GTTAGATGAGAAATTACTGCTTGATCAAACATCAAAAAGTTAGACATTTGGATATTTTCTCTAACGTTTAAGAAT
```

```
ATATAGATCTACCTGTAGAGGGTGGATTTTTGTCAATTAGTCTTTATAAGATACCAAGATGAAGTGTATTAATCA
CGAAACAACCAATCTTGATTAGTTAATTAGTCTCGGAAAAATAGACGTTCCGCGTAGTTTTTCAGGAAAGGGAAC
CAAAAAAGAAGTTAATGCAAAGTTAGACAACGAAACGAGATACGTAGAAAAAAAAAAAAAATAATTTGGAATTTA
CGGATAATCGGTTATACATTCATCTTGAGGAACAATGTACGATAATTTGCTCTATCACCTGTCATAAAACGACTT
TAGTGGTTGTTGTTGTTGTTGTTGCTGGTTGGATTTGGTCTGGTTGTATAGTTAACTATAAACGATGAAACC
AAGAAGAAGAAGAAGAAGGTGTGCAGAATAGAGTTTAATGGAAACAAACCAAATCATATCATATCATTTGATATT
ACTAGATCCAATCTAATTGCTATTCTCAACTCAACTAAACCAAATTTAGACAGAATATGGAAATATGACACCATC
TCTCTCTAAAAAAAAAACGGAGAACATTCTTAGAACAATTCTCCTAACGCTTGATTACGCGCGTTGTCGTCGTCC
TCTTCCACATACATAACTTCTTTAAATTAAAAAAAAAAAAATAAGATGATAATGAAGATGATGATTTAATTGCAG
ATTGCTGTCAAAAAGCATAGACAAAGAATAGATAAACAAAATTTGTCTGTAATACATACTATTGTGGGAACCATT
ACATAACCATTCCATTTAGGTCTGTAGGTTTGAAACATATCAGACTTAAATTCGTAGTTGTAAAATAATACTAAA
AAGTAATAACAATAACAATAACAATAACAACAACAATAACAATCATCTGATTTGAATTGGATGATTTCAATTATA
GAACAAGGAGACAAAATAAGACAACCTAGTAATAGTTAATTGGTAAATAACATGAAGAATTAAAACTTTAATAAA
TATGAATAAATAACTCGGGGGAAGAGGAAGACAAGTGAGGTGGAACCGAAATAGAAGAAGAAAAAGAAGAAGAAG
AAGAATATTTGCCGGATATAAAAATTGATTGGCACAATAATTGATTGATTGATTGATTGATTAGTCAGTTTGAAA
TTTTAATCTCTTAGACAAAATTGCTCACTTTCTCACTCTTTGGAGTGTGTCTCTAATATCCGTGTCCGACGTAAT
GAGTAAGCAACAGACATACATACTTACATACACACGCACACGGATATTATGCTTTTAACCCATTATGCATATACA
ATGAGTTCTTTTCTTTTCTTTTCTTTTTTTTTTTTTTTTCTCTTAGCAAAAGAAAGAAAAAATAATAAATTTG
GGGCAGTCTAGATCCGTCCGTTTTTTTTTGTATTTTTGCTGTCACACACTCTTTTTCTCTTTCTCTCTTTAATA
CTTACAGCCGATATTACTCACTCACTCACTCACTTACTCATATTCACCCGCAAAAAAAAAAAAAAAAACAACTT
AAACTAAATAACTAAACAACTAAACACAGACAACTCTTACTAATGGTGTTGCCAATTATAAATATTTGATTAAAT
TCCTTCTTTTTTATTTTGGGATTTTTTACAACAATTACCCTCTTTTTTCAAATATCCAAATCTAAATCTAAATCT
TTTAGATTATTAACCTCTTTTATTAACTTTACTTTACTTTATTCACACATTGACTCCACTACTACTACTACTACT
ATCACCACTTCTGCAATTATGTCGCTGCTGCAACCTCAAATGTCTTTTGCTCAAACTTATATATTAGCCAGCAAA
GTTAGATCCAAATTAACTAGAGAAGCTCAATCTCCTAAATCTTCATTAAGAAATTTGGTGGTTCAAGCTAATATG
TTGGATAATATTATGGATTATATTAGTGATGAAACTAAAAGAAGAACTAGTGAAAAATTAACTTCCAAAACCAAC
ACCCAGAAGAGTTCTAGTGGGTACCTTAGTCCTGAATCTTCAATGGTTCAATTTGCTCCAACTCCAGTTAGACAA
GCTTATAAAACTTCAATTACTGAATATGAAATTGATAGTGATTCATCCGATGATGATGAAGAAGAAGAAGAAGAA
GATCATGAAGATGATAATGAAGACGATTACTTTTATGAAGATGGTCAAATGATTACGATGATCTTGATGATTAT
GAAGATTCTGTTGTTATGGAACAAGATGAATTAGCTGCCATTAAAGGTGTTTACTACGAAGAAGATCAAGAAGAA
GAAGAAGAAGACAATTTATCTGAAACTTCATCAATTTATTCTAATTCATCAGATTCTGATTTAGATTCTGATTCT
GATGAATATTATATTTATTCTGATTCCGATGAAATCATTGAAGAAATAATATTGCCATAGAAGCTACTATTCCT
AGAAATTTCAAGAGTTTATCGATTGTCCCACCACCATCATCAACAACATCATCAACAACATCAACAACACAGTCG
CCATTGCCATCAATTGTACGTTCTAATTCTACCCCAATCACCATAACATCATTGCATACAATTGATGAACAACAA
GAAATTGAAGAAGAAAAACAACCAGAATTGTTATTACATGAAAATAATCAAACTATAGATTGGAAATTGAAAAAT
CATAATCATCCACAAAGTTTATATAAAAATCAAAACATTTCTTTAGATCAATTTTTTTAAAGAAAAGATTGACTG
ACACGATATGGACAGGCTTATGATTACGATTACGATTTACAACTTGTTGATTGATGATTACGACAATTAATGTTT
TTTTTTTTTTTTTACTTTCGATGTTTATTTATTTATTATTTCGTTTTCGTTTTTTTTAATTTTTTTTTTTAT
TTCTACGGTTTTATTTCAATTCTTTTAGCAATAGTTTTACCCATTTACCCATTTTATAGAATTTTATACAATAAT
TAACGTTATTTTTTATTATTAGACTTTTGTAAATCATTAGAGAGGGGGGGAGAAGAGAAAGTATATACTGTGTT
AATGTAAAATATGGGGTCGCCATAAAATGAACAGATGAGATTATAAAGAGAAGTTTTGATAAAACAAGAATTTAT
ACGTTAGAGCAAGAAGATTTTGGGGGAAGAATCGGAAAAAAAAAAAAAAAGAGAAAAATTCAGTCCTTTATGCATG
CGTGCGATGAATGGATGGATGGATATGGGTGGGGATCGGTAATTCAACAGCCGGACCGAAATTAATCCATC
TGGGGCAGAGACAGAGAGATCATGGAGTTTGAAATTCGGGAATTGGAAATTCGGAAATTAGTAATTAATAAATAT
CTTGTTGCTATACATTCCAAACAAATATAGATTTAAAAATCTTTTTTTTACAATAGCAATAAATAAAAAGAACAA
AATATGAGAGGGAGTCTATACAAAATTAAGAATTTGTTGGTTCGATTTCACAACTGAAATCAATTATGCAAACGA
CGACAAGCAAAAAAAAAAGAAAAGCTGGTCATTTGTATGTTGTTGTTGTTGTTGTTGTTATTACAAGGTTA
ATCTAGATTGACATAGCCACAATCCCTATCTCTCCCATATTATTATAAAATATTTCTTGGGTGTTCTGGTACGAT
TTATATATATAAAAGGGAAAACGAGAGTAATACCAAGATTTTCTTTCTTTCTTCCTTCCTTTCTTCCTTTCTTC
CTTCCTTCCTTCTTCTAAGCTAAAAAAATATACTGGTCATCATCATCAAATGTATGTCAAGAAATCAAAAATCG
ACACAAAAAACATAAAATATTCGAGTACAAAAATAAGTTATCCCACATAAGTAGAATTGAGCATGTATGCATAA
GTGGTGATGGTGGTGGTGTAGTGTTTTCTTGTAAGTGGGGATAGATAGATGAAGTGGCTGAATAGTTAT
TGTTGTTGTTGATGTTGTTGTTACAGATACATTATTTGATGACTCATCTCCGTGGTATTGTCAACAATTCAA
TTCAATTCAATGCAATTGCAATTACATTTCAAATTCAACTTGCATTTACGATAGTACGATTAGAAACATTTCTTG
TTAATAAAATAAGATTGACAGGTTAACAAACAAACGGGTGATAGCACATTCGATGGAAATTATTAGAGAGAGAG
AAAAAAAAATATAAAGACAGAAAGAAAGAAATGTCTCCAAGACAAGACAAGACAAGACAAGATAACAAAAACAAT
TACTTACATTATGATGAACCATGTATTAACCCACAGAGGTAGTTTAATTTCCATCCATCAAGATTAGCAAATTAC
GGATAATAAGAGTAAATTGTAAAATAAACAGCAAGTATCAAAATGAGTCAATGAATTTTGACAAGACTTTTTAT
CCATCCAAATGACAATATTTTTTTTTTTAAACAAATCTTGTCTATCACGACGTTTTAATTTCTTGATTTAACA
```

```
ATTATTCATTCATCCCAACAACAACTTTGCTCTTCTTAAAATCTAAATATAGAATAGCTGTTTTCCTTTTCTTTT
CCTTTTCCTTTTCCTTTCCTTTCCTTTCCTTAAAATGGTGGGAAATATTCTTAATTTTGTGTACGCTTCATTAGA
TTAGATTTGACACTTTTATTTTCTTATTTTACCCCGTTGCATTTTATATCCCAACACACACACTCTCTCCACACA
TTCAACTCCACAAATCAAGTCAATAAATTTTAAATCTGTCGATTTAATTCATGCACCCAACTGAATCATATTTAT
CTGTAGTTGAAGGCTCATTTATCTGATAATGAAGCCAAAGCCACATAGATTTTGCATGATCATAATCTTACAGTA
AGATATTTATTCTTGGTTGATAATCATACATACATACATACATACATACAACAAATACCAGAATTGTTTATTAGA
GTAAAATGGTGAACTACCTAATAGATTCATCCAAAAGATATTGCAATCATTAAGAATTTGTAATACAGAAAAAAA
GGTCATTTCTGGAGATAATAAACATTGCATAAGCCTATGAATCGTGACTCTCTGTATACTTTGGGCTTTATTAC
GTACCGGAATTATAATTCTTTCTATTATTTCCGGTTATCCAAAAAAAAAAAAAAAGAATATCCGAAACAAGTTAG
CCATCCACAAATTATTGTCCCAAATCCTTATATATCTACATATCCGATAACCGATAAGCTTACAATTATCTCCAT
TTTCATTTGTTTCGGAGTATAATCTAGTTTCTGGGGGTAGATTTTACTGTTATTGTTGGTTGAGTAATTAATTA
ATTAATTGATTAAGTTAGTAATTAATTAGTTTATTTCTGGTAACTAAATATATGTTGATGTACATGGCTTATATT
ATAGTATATATGTGTTATTCGAAATTTATCTATATCATTTATGGAAATTGAACTTATCCAGAAATTTTGGTAAAC
GACTTGTTATTCTTGACAGTAGGCTACCAGCTACCACCAAAGAGAATGCAATTATTAATATCTAAAAAAAAAAA
AAAAACTTTCTTATAGTCTTTTAATCCCATCAACAATATCTTTCTCTTGTTCTTGAATAGTCTGATTCTCTCCTT
CTTCTTCTTCATCATCATCATTTTGATTAGCTAAACCTTTTTCAAATATTTGTTTCCCAGTTAATTTCCCTTTAT
GCATATTTTCAAATCTTTGTTTATCATATAATTCATATTTCATTTCTTTTCGGAAATTATTTCTCCAATTTAACC
ACAGTTGTTTAGTAACTTTAGTACCATGAAATTTTTTTGTTCATTTAATTCTTTAATTTTTGTTGTTCATCAA
ATTCACATTGTTTAATGTTTAATTTTTCATTGAATAAATTTTCCAGTTCTTCTTTTAAAATGGTGATTAAATTGA
AAATCATTGGTATACCTAAATTTAATTCACTTTCTTCTAATAATTTATTCATTAATGTATCATTAAGATCAGTTT
TAGGATCAAATTCAATGGTTTCGGCCATATTTAATGCTAATTTTAAATCTGCATTTTCATCGTCATCGTCATCGT
CATCACTGTCACCTTCATCACTGTCACCGTTATCATAGTTGTCTTTATCTTCTGGAGATTCAGCTAATTCTATAG
ATAATTGAGGAATTACTTCAGGATAAGTAGGAGGATATTTAACAATTAAATTCAAACTATGTTTCCTTTTTGATG
GTGTATCTAAATCTATTCGAATGATGAAATGAGTATTATTAATTAAAGTCAATTCATCAGGATAAATTGATTGTA
ATACTTCAATCTCTTGAGCTTGTTCTTCTATTGGATCCATAATTAAGCAATGTACACAATTATGTGTGTGTTT
AAGGCGCCCTTGTTTGAAAAATTTTCTCTTTTTCTTCTTCTTCTTCTTAGGATATAAGACACGCACACATAT
TAGTTAGTGTCGTGTGAAATTGGTCAGAAATGACATGTTAGTTAGTTAGTTAGTTAGTTAGTTTATACTTTATCA
ACTTATCCCTCCCCCCCCCTTCCCCCCCCTTCCAAAAAGTATTTCAAAATTGATTAATACATGGTTAGATTTTC
AATTAATAACTTTTCTTAAGAAAAGTTTCATTTGTTTGATCTATTTTGACGATCTAATTATTGTTAATAGTTAA
ATAGAGTCGGCAGTTTTGTAGGAACTTCCCTAGAAAAAGAATACATTTGCAATTAAAACACAACACAAACAAAAA
CACAAACATCAATCAATCAATCAGTTCTCAATGTAAGAGAAAAAAAAAAGAGAAGCCAAAAAAAAAAAAAT
CATCCTTCTTTTTAATCAACAACAACATTATCAAGTTTTATCTTTATCTCATATTACAATATTAATTCCACACAC
TTCACATTTTATATATTACTTATATCCACATATAATACAGGTATATTGGTATCTTTTTTTTAGGTGTTTCACATT
ATTCTCCGTTCACTCATTCATTCATTCATTCTTGAGTCTTTTTTTTTTGTCTTGTTTGTCCTGTGTGTGTGTGTG
TGTGTTGATAAATCACCTGAAACATATACTATTTAATCATTTGTTATTCATCATTATTGTCCATTTTGAATAG
TACTGGTTGTCATTTTTTTGTACATTCATATATCATCCATTAAATATCGATCTAAAAAAACTTTTTTATTGAATC
ATTTGATTTTAACATATATTTTTGTATCTTCAAGGACACAATAATTTGAATTTTATTTTAAAAACTACTTTTTG
GCATAAAGTGTCCTAATCATTAACTTCATCCTCATTTACATTTATCACCAGCCCATTATTTTGGCATTGCATTAC
CCTTTTTTTTTTGTTTTTTTTTTGTTATCCTTCTAATTTATCAAGGAAAGTATTAATATTATTTCATTTTTATCAT
TTTGGTTTTTGTTTTTTGTTTTTTTTAATGACAAGTCATTTCCCACCAAATACAAAAATAAAAGATTTTGGATAT
CCCGAAACTCATCCATTTCATATTGGTAATTATCTTTTAAAATCTAATGGTTCAATATCATCATCTCCTACATCA
TCAACAACATCATCCTCTGCATCATCATCATCAACTACTTCATCTTCAGCATTCATATCAAATAAACATGGAAAT
CATCACCATCACCATCACCATCACCATCTACCCAATAATTATATGACAAATTCTTCCCAATTTATACTGTCCAAT
GATTATAATAATACTAATAATATCAATGACGATGACGATGACGATGATAATGATAATGATGATGACATTATA
GATGACGATTATGATCAAGATGAAATTAATTGTAAAGCAAGAGCAATATTTGATTTTCTGCCGAGAATGATAAT
GAAATATCATTAATTGAAGGACAAATCATTTGGATTAGTTATCGTCATGGTCAAGGTTGGTTAGTTGCTGAAGAT
CCTATACTGGGAGAAAATGGATTAGTCCCAGAAGAATATGTTGAAATTATGCAAAATCTTGATAATAAGAATAAG
AAGAAACATAAGAATAAGAGTATAAAATATTAATGGTGATTATCAAGAATTTGGTCATCAATATGGAAATGCAAGT
AACAATCAAGATGAAGATGTTCCAAAAAGGTTTTTACCAGAAATATTTAATGACCATATACACCAAGATGATGAT
GATGATAATGTGGATTGTGATAGTGAATGGGTAGATACTGATTATGAAGAAGAAGAAGAAGAAGAAGAAGAA
GAAGAAGAAGAAGAAGCAGAGGAAGAGCAGGAGCAGGAAAAGCAGCAACCACAAGAAGGAAAAGAAGAACCAAAA
ATGGAGATAGCGAAACTTGAACAACCAGTCAATAAAGAAAGTGAAATCAATGGTGAAACAATAACAACAACTACT
GCAACAATTACTACAACAACCACTACAACGATTGAAAAGATCAATGCTATTGAAAAGAAATTAAATGATGTTGAA
ATATGATATAATGAAATTTGTTTATTTTAATGATGTTTTTTTGGGAGAGGAGGGGGGGGTCCAATATTAGCC
AGCTTATAGGGACAATTAAGTTATATTAATGTTGATTACGAATTTTATCAAATGTTTTATACTTTCATACCAAC
AGAGTGTATGTGTAAATGTATAGAAGAAGTGTATATGTATTTTGTATTATCAATAAATCGAATCAAATTAAATTT
ATATTCTTCTTCTTCTTCTTCCTCCGTTTTTTTTTTACAATAACAAAATTAGAAAACTATAAAAACCTTT
GTAATAAAAAACACTTTTCTTGTTCTTCTTGAATTCATACATTATAGTCCAATTTCACTTGCCATTATAGATGGT
TATGGTTATAAGTATTTATATTATTTGATTGAATCTTCTTTCCATAAGTATAGTTAACGGTAGTTAGTTGATAAA
```

AATTTCCTTTGCTTTATCACAATTGTTGTTGTTGTTGTTGTTGTTGCAAAATAAAAAAAAAGCACCAAGACT
GAATCCAAAAGTCAAAAACAAATTTATGCCTTTCAATATGATTACTCAGATTCTATTATAATCATTTTTGGGATT
TGGCCAGTGTTGGTTGCAAATACCAAAGTCAGTATATACGTGTCGGCTCTTGAAATACTGTTGATGCTACTATAC
AGGGCCAGGAAGGGTTCGGCCAACAGTCAACAACTAAAAGAGCTCCCCTCAGCTCTAAGTTGGAAGTATATATAT
ATGGAAACACAATTAAATAAAGCTAAGATATTGGTAAGCGTGGACCAATGGATCAGTCTTACGGTGCAAAGTCGG
ATTTGACACTCAATTCCATTTTACGTAACAGAAACGTGATGATGATACTTTGGGTGCGTAGTAAATTCATCATTA
TTGTTCTTCAACTGGAAAAAAAAAAAAAAGACGCATCATCATTACAAAATATAAACAAACACAATCATCACATCAT
ATCACATCACATCAAGCAACAATTGATAATGAAACTAGATAGAAATATATGATCAAAATGAAAACCAACGAAGAT
AAATTAATAACAAATGACAATCTAATAGAGAGTGTGCCGTCCAATAGCAATACCAATAGCAATAC

YJR115W_homolog_1 63aa PathoSeq: 1..63(SEQ ID NO 660)
TTTITTSAIMSSSQPQMSFAQTYILASKVRSKLTREAQSPKSSLRNLVVQANMLDNIMDYISD YDL075W_homolog 513bp PathoSeq: 1..513(SEQ ID NO 661)
ATATATCAATGATTATGATTTGGATTGAATGGATAGTAGCCAAAATCCCATCTTCTATCTCCATCATCAAATAAT
GTTTCTTTTTCATCTATTATACATTCTGACAAATAAACTATCAAGGAAATATCAAATACTAACAAATCGTTTGTT
TTTTTTAGTTACACGGTGTCAATTTCAAAAAGAGAGCTCCAAAAGCTGTCAAAGAAATCAAGAAATTCGCCACTT
TACACATGGGTACCACTGATGTTAGATTAGACCCAAAATTGAACATTGCCATTTGGAAAAGAGGTGTTCAAGGTG
TTGAAAACAGAATGAGATTAAGAATTTCCAGAAAAAGAAATGATGAAGAAGATGCTAAAGAAAAATTATTTGCTT
ACGTTGAACCAGTTATTGTCCCATCTACTAAAGGTTTACAAACCGTTGTTGTTGAAGATGATGAATAGATGATTT
GCTAAAATATATTTATATGAGTTAGCATTATTAATGTCATTTATTTAGGGGGTTATTTTAAAT YDL075W_homolog_1 93aa PathoSeq: 1..93(SEQ ID NO 662)
LHGVNFKKRAPKAVKEIKKFATLHMGTTDVRLDPKLNIAIWKRGVQGVENRMRLRISRKRNDEEDAKEKLFAYVE
PVIVPSTKGLQTVVVEDD YDR064W_homolog 5975bp PathoSeq: 1..5975(SEQ ID NO 663)
CCCTATTCATCTGTCTGAGGTTTTAAATGTGGAGATCATAGGTACTAAATGTGTGCCCATTCCAATGCAGATGG
GGACTCGAACTTTAATTCTTAGTAAAAGAAAAAATTATATCGCATCTTGATAGAAGATTCTGATGCTTAGATTTT
TCAGAAATCGCAATCTTCAATCGCGTCATATCCCAATTTATTCAAGAAGTCTTACTTCAAAATACAACAGACAGC
ATGGTATGTATAGACAGACTAATTCATTTAAAATTGAAATTGATTATGTATTGGCAACAAATATTAACATTTCATT
TAAGCCACCAAAAAAGAAAACGGAGAATACAAGTACCATTCTCAAGTTGAAAAGATATACATCTACTTTTATATT
AACGATTGAACCATCACACTCATTAGAGGATATCAAATATCAATTGTGTAATATTATCAACAACTCGGGAGGATT
ACCTGCAATTCAAGACCTGGAGGTGAAGAACGAAGATGAAGAAGATATTGCAGTCCCAAAATCAGAATACATCGA
TGATGTGGATGAAATCAAGGAAGAAGTACAAGACGAGTCGGCCATAACTAAGGTACTGGTAGATGATATACGAGT
GGCCTATCCAAAAGATTCAACTCAGCCTTATTCCAATAACTGGATTGAATTGAGTGAAGATAGTGATATTGCTGA
ATTAAGTTTAAAGGATTTCGATATATTGGCTTTTGCATATGGTTCGGAAGAACAAATTGAAATTGTTGAACCAGC
TTATGAAGAAAACTAATTTAGAAAAAGTATAAATACGAAACAAGTCTATAGTTTTACATACTTTTAGTATACATT
GATTTAATGAAGGTGAAGCAAAAAAGAAAGAATAACAAATAACAAATAAAAACAGGTTATCAAAAGAAATGAACT
TAACATACATGTACAACTAATGTTTTCCACTTAACTTTCTCACACCACCAGAGTGTGCTCTTGATGTTTGTG
AGTTTCCAGAAGCAATCCTATTTTTGGATCTGGCTTTAGACACGCGCAAAACATTCGTGGGGGATGTACCTGGTG
GAGATGATAATGTTTCATTGACTGTTTTTGTTGTTGTTGTCTTGATAATATGAATTGATTGCTGACTAGATACAC
TGTTGGTTGATATTGATCTCAAAACTCTCCAATCAGAATTATCCTTTGTTTTTGGTGTCACTGAGTCATACCTTG
CTGGTGAGCTTTGAATTATATCTTGCATAGTGTTTTCATCGTCAGAATTGTTCACCATTTCTACCTCGTCAATAT
CTTCAGAGTCCTCAAAATATTTTCTTGGTTGTCCAGGAGACTCGATAGGTACCACAGTTTGGATTTAGATGCCA
AAGCACCACTCACCTTACGTCTTCTAATCGGGGTATTTATTACAGAAGAATCAGCAAGTGGAGATGTCAATTGTT
GTTGCAATTGCAATCTTTCTTTTCTTTTGCCTCTTTTAGTCTTTGTTTATAGTCTTCATAAGAGCACAATGGGA
ACAAGTTGCCAATTAAAGGATCGGGTCTATTGTCTACTATCATTGTATGTCTCCAGCTTCTAAAATCATCGTGGT
GCAAGTAAAGCCAATGTTGTTGAGGACCAACAACCATTCCTGGTCTGATCATTCTCATGTACGCGATACATTCGT
TGGCTGTAAATCCATGAGTGTATATGAGATGGGCTCCAATCAAACAACCGGTTCTTCCTAACCCTGCTTTACAAT
GTACTGCAATTTTTCCACCTTTATTGATAATACACTCTGCAGCACCAATAAATTTTTGAACGTATTCCAAAGTAG
GACAAGTTCCATCATCGAAAATCATATCAATGTGCTTGATATTTCTCTTTGTAAACTCTTTTGCGTCGTATAAGT
GAGAGTTTAATCTCACCACAAGCTGGACGTTGTTTTCCACGAAGTACTCCAAAACTTTTTGAAATGGTTCGTTTA
ATCCTCCTCGCTTGCTTTGTTGAGGAGATGCAAATGCAATGAAATCTNTGGATATAACGTTAAAATCTCCTTGGT
CGACTCTTTCGTACTGTTCATACTCGTCTAAATCAAATTTGGCCAAGTCAATCATACCTCTCTCTTTAGCTCTCC
ACATGGCATACACGACATCCTGAATAGTTATTTCATAATCCGCACTGCTATATCCTGCGTCTCTGAAAGCTTGTA
AAGGTGGCGTGATTTGAGCAATAGGTTGCAAAACTTGATGAGGAGCCCAATTCTGGAGCAATATCATGTAACAGC
ATAGTAAACATGCTAAATTGGCTCTTTCCTTAGGGGATGTCGAACTATATATCACGAGTCCCTTCCCTTGGGTTG
AGTCTTCGTTTAATTTCTTGTGTAAAAGAACTGCAAAACGATATAAATGCCCAATGTTCAAAGGTCCGAAATCCA

```
TGTAAAATGCATTATATGGTAATGCGTCTTCAACTGTGAAATATGCCAAATCTTCTGTATCCCTTTTGTGATGAT
CATAAGCGCCAAGGTATATTCTATCTGTAAATGGAATTGTTAGTATATAATGTTATAAAAGGTAGAACAATCAAT
TTGAAGTAGATTTTCCCAACATACTTTTAAGAAACTCTATAAGAGGCACATGAACCAGTGAACTATGCATCGGAA
AAGGTGTTTGTGATTATTAGGTAGTTTAGAACGGTATGGTAGAAACAAACGTGTTTTTGAATGAAAGACAAAATG
TACTTATATGTAGAAAATACAAATGAATGATAGACGTTGAGTTAATTGGATAAAATTGAAGACATAAAATAGAAA
TTCAAAAAAGATCTCTTCCATCAAAATTTATGTTGTTTCACTTTGTTTTTGTTTTTGTTTTGTTTTGATTTCTTT
TTTCTTCTTTGAAATCGCTGAATGGAAGCGTACTGTTGTTGTTGTTTTGTTTTTGCTGAATCGGGTAAGATTTGA
ATATTGTGCACTACTGTAGCAAACCTCAATCCAAAAAAACTCCAAATCTGATTGTGAGAAATCAAAATTTTAGG
TGTATTAATCCTTCATAGCAAAGGAAAGGAAAGCCATGGTACGTTCAGCATAACTATTTTTATAAAGCTTGTTCG
CTTTACTAACCGGACCATTGATGATAGTCATCTTCGTTATATACATTTTCTCCAGAAACACTATCAGCATTAACA
AAGTTTAGATTTCAAAGTGCCAAAGTGGATAAAGTTCAAGCTGTTTATATGTATGTATTAAAACAATGCCTACAAT
TTTGCGATTGTTTAATTTTGAATACTAACATGTCAATGTTAGACACGATTGACAAAAAGAGTCATGAAATCAAAC
AAGAAGATGAAATTATAGATTCCATAGAAGAATTGGTTGAGGAATTACCCGACACCTCTCCTAGATACGTCATCC
TATCATATCCCTTCAAACTGGATGATGGGCGATTGAAAACACCATTAGTTATGTTATACTGGATCCCACCAACAA
GTGGACAAGAAGTAGAATGCTCTATGCTGGTGCAGTTGAGCAATTTAGAGATAAAGCTGGAGTCTCAAAGTACG
TATTACAGGTAATTCTGCCTTTTAGCTGAACACATTAGTGTACTAACATCCATTTAGATTGATCAAACTTGAAGA
AGAAGAGGACTTTGATGATTTGAAAGAACAATTGATTTAGAGGGGGGGTTAACAGTTCTGTATTATAAAAATGAA
TGAGCTTGTAACTGGTCTATCTATCATATAGCTCTCCTTTTAGTGTATAATCTGATTCCTGCATATATTGCTACT
CATTTAATTTTTTGTTACAAAGTCGTGTGCATTACTATTCTGTAGAAATGAGTAGAGAAAAAAATTTTCAGTTGT
TCTTCCTCTTTAAAGGAAAAAAAAAAATTTTCATTTCCTTTCTTTCTCAATCTTCTTTTCTTACCACTAGTCAA
TCAATAAAATAAATCAGTCATCATGGGTCGTATGCATTCATCTGTATGTTATCAATCAATCAGTCACTAAAATCA
GCATCACATACTATTAACATGATAGTGGGAACAGGAGTTTTAAAGAAAAAAATGGATTTGTTTGGCTTTAACAAA
TGAAGAGGTCTTGCCTAAAGTAAACAATTCGTCTACGGTCGACAATAAACAGTACCTAGAATTGTTACTATATAC
GCTTTAGGTATTTGATACTTTTCTTTGATTATTGCTAGGGATGGAGAGGAACACTGGGATGGACTAATCGTCTCG
GTGTCTCTTCTTTGTCTTAAAATTTCAAATCTAAGTAATTTCAATTTACTTTTTTCTAATATGACATGTCAAATA
TTGCTCCAGATGTTAATTGGAATTTTCTTTTCTTTGCATTGGGTTAAGTTTTACTAACATCTTGTTGTTTAGGGT
AAAGGTATTTCCTCCTCCGCTCTTCCATACTCAAGAAACGCTCCATCCTGGTTCAAATTGTCTTCTGACGATGTT
GTTGAACAAATCATCAAATACGCCAGAAAAGGTTTGACTCCATCTCAAATTGGTGTTATCTTAAGAGATGCTCAC
GGTGTTTCTCAAGCCAAGGTTGTCACTGGTAACAAGATCTTGAGAATCTTAAAATCTAACGGTTTAGCTCCAGAA
ATTCCAGAAGATTTATACTACTTGATCAAGAAAGCTGTCTCTGTCAGAAAGCACTTGGAAAAAAACAGAAAAGAC
AAAGATTCTAAATTCAGATTAATTTTGATTGAATCAAGAATCATCAGATTGGCTAGATACTACAGAACTGTTGCT
GTCTTACCACCAAACTGGAAATACGAATCTGCTACTGCCTCTGCTTTAGTTGCTTAAGAAGGTTAGTTATTTGTA
TATCTTGTCTTTTTTTATATATATAAACATGTATATTATTCACTAATTAATATTTTATATCAATAACGAATGGA
AAGTAATCGTTTTAAAATGATATGGTTCTCAAAAATTAATTGTAGTGTTTGAAATAGCATGGCTTGTTGCAAGAA
ATTAGTTTGAAAAATTATAAGCACCCAAAAAAAAACACTTCTGAAGAGTTTTCGTAGAAGACTTTGAACATTCTT
TTAACACTCAACACAATTATGGAAGCCATATCCGATAGACTATTTAATGAGAATGCAAACACGATAGAAGCAGGG
AATGATGACCCATCATTATTGACTATAATACTAGATCTTTCAATGAAAGGATGGTATAACATCAAAGAAATGATT
TCAATACAAGATATCACCAAATCATTACTAGTTTTCTTGAATGGACATTTGTCATTAAACAATAGTAATCAAGTG
GCATTTTAGTGAGTTCTACTATGGGTTCTAAATTTTTATATCCCGATTTAACTATGGTTGGAAACCCCAACGTG
AGTGAACATTCTGAACATTTTCCTGACATGTATCGACTGTTTAAAATGGTTGACCAATCTGTGCTACAACAATTG
AACGAGTATATTGAAGAGATTATCAAATTCGAGACAAGGAATGAAAAAAAGGGTTTCAATTGCTTGACTGGAGCA
ATCAGTATGGCTTTAACGTACACAAATAGAATGTTAACGTTGGATCAATCAATCACCACCACAACTGCTGCTGCA
ATGACAGCTTCTACGCTTGAAAGTACATCCAACAACAATAATACTAGTGGCACTAGTGGATCATCTAGTACCTCA
TCTAGCACATCGATGAAATCAAGAGTTTTGATTGTGTCTGCTAATGATGATGACGATCTTAGGTATATTCCATTG
ATGAATTGTATATTTGCTGCCCAGAAAATGAAAGTGTCTATTGACGTAGCAAAATTGGGTCATAACAACTCATCC
TACTTACAATAAGCTTCTGATGCCACCAAGGGGGTTTATTTACACATTGAAGATCCAAAGGGAATAATTCAAGTG
TTGTCAACCGCATTTTTTATAGAACCCAACCTACGACCATACATTATTTTACCTACAAATTCAAATGTCAATTAT
CGAGCCAGTTGTTTCATTACTGGGAAATCAGTAGATTTGGGATATGTGTG
```

YDR064W_homolog 143aa PathoSeq: 1..143(SEQ ID NO 664)
GKGISSSALPYSRNAPSWFKLSSDDVVEQIIKYARKGLTPSQIGVILRDAHGVSQAKVVTGNKILRILKSNGLAP
EIPEDLYYLIKKAVSVRKHLEKNRKDKDSKFRLILIESRIHRLARYYRTVAVLPPNWKYESATASALV YKL156W_homolog 2002bp PathoSeq: 1..2002(SEQ ID NO 665)
```
ATTCCTCCCCAAAAATAAAAATAAATATGGATAGAATTCCTATGATACATATTATATTACCAACTTTTCTTTTCT
ATTCTTCTTCTTCTCTTTAATAATAGTTTATTTCTTCATGCAAATTTTCATTTTCATTCTAACTTCTTGGTGTTTT
CTTTATTGTTGTGATTGTGTATGTGAGTTTTTTTTTCTTCTAAAAAGCCGTTTACTTTCTTCTGAATGAACAACC
TTCAGTCAATTTAGCTTTACCACCAGTTGGGGTACACAAAACAGTAGAACAAGAGTCACAAGTGACAGCAGTTTG
AGCGTGACTGAAAACAGTGGTGATATTAAGACATCCTTGACATTTAACGTCCATAAAGAAAGATCTTGGTTGTTG
```

```
AACTAAAGTTTTCAATTTGTGTTGTTTAGCTTCAGTGGCTGGAGATGGATGTAATAAATCTTGAACTAAAACCTA
TACGAAAAAAAAATAATAGTTAGTATTACATGTTTTATTTGAAAGATTGTGTCTGAGTTATGTCAATGTGGGAAA
AGGAGGGTTATATTCGTTTCGATGATTTCAGTAATAACACATGGATCCACACCAAAAGTATATTTCTTTGACGTT
TTCTGAGGTGGTAACTTTCATGCTGATTCTCTTCTCATTTTCCTGTTCTTTTAAAGTAGTAGTTGATATTAATAT
GTTGATCCTAATTCATTATTCGGTAGTACAATGTTTTCTGATTTGTTAATCATCATTCCGTATTCTATGCTTCCT
CTTATTCAATTTTTATTTCAATTCAATTATATCTTGATTCCAGTAAAATAGTATACTCCTATATTATGATATTCT
GATCATCCAGGAATATCCCTCCATAACTCATGGTAAATCTAATGAACATACCATTGTTAACTTGTTTCTCTAATA
TGTATAATTCAAAAACTGAAATCTATTGAAAACTGAAAATTTTTTTTTTTCTCTTTTCTTCTTTCCAATTAGGT
TTCGTGAGTTACCAAAAAAAAAAATGCGATAGTATGGCAAGAGAGAAGAAGATTTCTCACTATACGCAGCATATT
GGGGGAAGAAGTTAGTTTTTTTTTGTTTGTGTGTGTACAAATGTACACTTTTCACTCAAAGCAATACATCACGTG
CAAACAATTAGGGCTATTAGGGCTCAACATTTTTTTTTCAATTGTGAAACAACCAAAACTAAAACTGCAAAAAG
TGTCAAGAATAGCTTTTCAATGGTTGAGCCAATATTTTATTTGATCAGTAAACTCATTTTAAGCAGAGAATACTG
TCCCAAGGTTGAATTCTTCTACTACCAATTTGAGATGTGACTTATTGGATATATATTTTGCACCTTCCTACAGTC
CACATTCTACACAATGCCTACAAATGAAAAGTACTCACTATGATAGAGTATTCTGTTTCAGCACTACTAAATAT
GCACCAGAGTTTACATCTATCGTAATTGTAAATCTTTATGAAATTTTATCAAATAAACAGAATCAGTTTTGGTT
GGCAAGTTTCTTAATTTGACTGGTCTCATCTTGGAATATTTTTATTCTAAACTATGCTTAGGTACTGATGGGAA
AAACCCTTCTTCCTGAATTTTCACCGCTCTTTGTTGACTATATTTCTTTTTTTGATAAGACATCAATCTATTTTT
ATAAATGTCTTGATTCAATTGATACAATTTGAATTTAAACTCCAGGATTTTCTTACTTGTTTCTTCTAATTCTTT
TGTAACATCGACCAATTCTTGTTTCAATTTTTCATATTTCGACTCTGTAGATTTGTCCTTATCCTTATCCTTGCC
CTTGTCTTTATCTTTATCCTTCTGTTTCCAATATCCTGCCACAGTGTTCCAAATGTATGGTTTTTCCGACTCAAC
ATCTTTCTCCAATTTTGATTTCTTGTCCGTGAGTGTCTGTTTTTTGTCTAGTAGTTCAGTGTATTCTTGAGGATG
TATGGCATTGGCAAATTGATCATCTAATAAATGTTGTGGACAAGTATAGAAA

YKL156W_homolog_1 81aa PathoSeq: 1..81(SEQ ID NO 666)
VLVQDLLHPSPATEAKQHKLKTLVQQPRSFFMDVKCQGCLNITTVFSHAQTAVTCDSCSTVLCTPTGGKAKLTEG
CSFRRK YLR038C_homolog 8469bp PathoSeq: 1..8469(SEQ ID NO 667)
CTGAATCAACATTAGAAACTGAATATAGTAACCAATCAAATCATTTCTTTAATGAATTAGGGAACCAATTATTAG
ACAAGGACAACATAAAAGTGGTTAAGATCCCGAAAAATGATTCAATCAAAAATAAAGTTGAAGCCATATTCAAAT
CTATTGAACAAGATAAACTAATACTTTTAACTGGATTATCGAATTCAATTGCCAAACTAATATATGTATTACAGAAA
TAGTCAAACAAAAACAGAATGAACAACAACAACAACAACATGAACCATCACAGAAATTAGATCAATATAACAAAC
TTCTACATATTGATAGTACAGTAAATCCTAGTTATAAACCCATACCGGAGAAAGAAAACAAGAAAGTCGATACAA
AACAATTGGAGAAAGAAGCTTTACAAGAAATCAAAGGTCCCAAAATCTATACATTGCCTGTGTTGTACATTGTGA
TAGGTAAACATTCAATTGTGTCAAATATAGAGTTAGTTAATTGGACAAAACAAGACAAATAATATGTAAATGTAT
AGTATATAGCATTCCCATCCAATACAATTCGAGTTAGAGGGACAGAAAAGAGAGACGGAATAAACAACATACTAT
AATAAGTAAATTGACAATAATGATGTGAAGCTGGTGGGTAGAGGATGGACTGTTTTTTTTTTATTTAGCCTTGG
GTACACATCTTGTAATCTGGACACTACCTACCAATTGGAATTCTGCTTTTATTGTTTAAGAAAATTCTATTGGGG
GTAGTGTGGTTTTGCAACAACCAATGAAAATTCAGTGCTTACCCAACTCACTCACTCACTCAAAGAAAAAATCGT
AAGATGGCAGGAAAACTCTTTAAAGGAAGAAAGAAGAAAAAAAAAAAAACACGCCCACTATCAAGAATACTTCT
TTTCATATCCTTTTACTTATTAAACATATTCATACATAATGCCAGTCGATCCAGCTACTTTTAAATTCGAAACTC
CACAATTTGACCCAAGATTCCCAAACCAAAACCAATCCAAACATTGTGCTCAAGCCTACGTTGATTACCACAAAT
GTGTCAATGTGAAAGGTGAAGAATTTGAACCATGCAAATCTTTTTCAAAACTTTCACTTCATTATGTCCTTTGG
ATTGGGTCGAAAATGGGATGATCAAAGAGCTGCTGGTAAATTCCCAGTCAACATGGACGCTTAGATTTTGAAAA
TCCTTTCCTTTTGTTTTTGTTTTTAATGATAACTTTTTGTTTTACATTCATATTATGTTAGTTTTGATTAGTCC
TTTTTTAGGTGGGATATATATTCTTTTAATTTCTTTTTTTTTTATAAAGAAAAGCTTTTGTCATTATCGTTTTTG
AAGTCCCTCCCCACCCCGTCATTTTTGGCTTTATTTTTATATATACACATAAATATTCCCATCCCACTACATGT
CGATTATATACAAAAGAGAGAATGAAATAAATGATAAAAGAAAAGAATATTGAAAGGTTTTTTTTGAATTCTT
GATAATGTACATATTCTATGAAGAATGAAATCACCAGAAACTATCTTCGGACCAATTGGTAGGCTTGCTAGTTGA
TTCACTAGCAAACAAATCAGCATACGGGTCAGCATTTTGTTTCTTCTGATATTCGTATTGTTTACTTAACTCCTT
GGCCTCTCTTTCTTCTTGTTTCCTCTCATTAGCAATTTCTTTGATCAACTCATCCTGTTTGACAATAAACTCATC
AATAGGTACTTCCTTCTTTGTCTTATTTAACTTATTGATGATAGCATTCTCTTTTTTCACAACATTAAACCGTTT
CACAAGCTTATTGTTCTTGAAAGTGACTGTACCTATATCCATTGACCCATCTGTATGCAAATTCTCAACCGGAGT
ATATATGATAGACACATTATTTAGTTTATTACCCTTTATTGAATTAGCTTTAGTCAACTGTCCTAATTGATTAAG
CAAACCTTCGTCTATTTGGAAACTCTCAAAAGATTTGAAATTTTTAATTTGATCTTTGGTCAATTGCAAATAGAT
ATGTGCTGACGAAAGCTTGTCAACATGAAACCAAATATTTTGGGATGAGAATGTTTAATTAATGGGTCATTCTC
TACTTTATCTCTTCCCATATATATGGTAGCTTCGTCCGCTTGGGAATCATCAATAGCAAAATCAGCTAATTCATC
GTCTTTAGAGGTTACTTTCGCCGTAAAGTAGTACACCATGATGGGAATTGGGATTGAATCAAACTAAACAAGAAA
ATGAAGTGGGATTGAAAGAAAAAAAAAAATAGTACAGAATAAACATAATGAGACACACGATTTACAGACATACTC
```

```
ACATTACAGTGATAATCTACCTACAACATCTAGATAATCACTGAAACATATCCCTCGTTTATAGAAAGAATAAAC
TCGATGATCGATTTTTCAATTTCTACAAGCTTTTTTGATTGCCATACACTATATGCCACTCCTTACTGAGAACCT
ATATAAATCTGGTAGCTCCGAGTAAAGAGAAGAACTTGTAAGTCACAACAAGTAAACTATTAATACAATAAGCAA
CTCACTTTCTCTTTCTATATTTCATCAATCTACATTGCAAAGTGGAAACTATTAGACTACTAGTTGCTAATGAGC
TTTGTGTTGCATATACACATCTATTCATGTGTAGGTATTTAATTGTTAACATATACACTACTCCTTTCACTTCAC
AGTAAAATTTTTTCTTCTTCTTTGATTTTCCATTTCTTTTTTTTGGCCACTCGAAACCTAAACCCAAAATAATA
CAGACACAGACAACAACCAAAACTTGTTTTATTTGAATCAATTCATTAACAAGGCAATTACTAAATACAAGAAGC
TGCATTAGAGTATATATTGACTACTGATTAGATCTTATATACCACTACAACAATCAACCAAACAAATAAACAAAC
AAAGTTATAGATTTAGATCATTTTTTTTATTTTCCCAACACAACGAGGAGGACTTTACTAATTGCCAATTTTAAT
CCTTTTTATCCGTTTGATTGATTTATATTCCTATAGTTGATCACCACGAAGTTACATCGTCCCCCTCTTCGATCT
ATCATCAATTGAAAGAAAAAAAAAATCACCTTGAACTAACACCTCAACTGTGAGTTTTTAATCCATCAAATTAAA
AATTTATTATCGTGTCTTCATCACCAGTAAACGCTAGCCCACTGGGCCAACACCAACAAATAATAGAACAGCAAG
TCGAAAAAGAGCCATCTTATAGAATAGAGAATCCCGAATTAACCAAAGCTATTATCAATCAATTATCGATATTAT
TAACAACTGCTGATCACGATAATTTAGAATCACATTACCAACAAATCAGATTCATTTAGCTAAACAAGTATTAA
ACCCTATTGTTATTAACAATTATTACGAAAAACTTGTTAGTTTTATTAGATTTAGCGATTATTCTAATACCAAAT
TAACATCCATTGAAGAATTATTTTCTAGAGAACTTGAAGTTATCACAAAAGACTTGAAATACTTTGATTTATTGT
TTATTCATTTATCCAAGTTATTTGACACCAAAGCCATTGATATTATTGAATTTGTAAAGAGATTTAAGTGTGATC
CAATCTTATCCTTTATATTTTTAGTCAAGCTTGCTGATACCACATCTCACGAAAAAATCGACAGTTACATAAAAG
AGAATTCCATCGATTTATTAAAATCTTTAAGATCTCAAGAATTCCCTGCAAACTACAACTGGGTATTATTATTAG
ATTGTATATTAAACACTCCATTTTTCCCATTCATTCATAAGCTTTTAACATTAAGCTCGTTGAAAGCATTTAAAT
CAACTATTGAACCCGTCAACAAATTCTATCAAAATATATTAAAGATGTCATTCAAAGAATTATTAATCGAAATTG
GTCCAGAAAACTTATTACCAGAAAAATTGTTACCAAGCTTATTGCAGATCAAACCCAACGAAATTGATCAAGGTA
TAGCATTAATATTAGCTGAAATATTGATACCTGGGTCTCAAGGGTTATCCCAAGGATTGACTTTTGCCAGTAGCT
TGCCAGGCTCAAATGCCAAAGGCGCTCAATTACAAGCATGTTTCAAATCTATTGAAAACTCTGGGAAATTCAATG
TCAACTGGTACGAAGTGTTTAATCACGTGCATCAATATTTATTTGACTCGTCACAAAGAGATATCCAACCATCAG
TTGGCAGCATTACCCAGTTTTTATCGTCATTAGATTTCAAACAAGAACCAATAGATATATTCTTGAACTACGAAT
GGTGGTTCAATAAGACGTTGTTGTATATATTGCACTCACTGGATGCATCCCAGGGTGGTTATGATATATCGTTGC
TGCCTAATTTAGCTTATTGTTTTGAGGAAGATAAAACCACTCCCCAAACAAGAAGAAACATTTTGAAATTTATTA
ATGTGGGTAAACTAGAAATCCAAGTGATAACCAAAATACAACAGCAACAGCAACAGCAACAGCAACAC
AACAACACCAATTGAGTGAGCAAGATAAGAAACTAAACGCGTTTTTAAATCAATTGTTTGAGCATGATTATCGTG
TGTTCCCAGAATATATTTTGGCCGCTGCATTAACTGTCGTTGAGAAATCCCAATTTATAAATGACTTGATTGACA
CGTTGTTTTATTTGTTGGTAGATAGCGCTAGTCCTTCGTTGCCCAAAGTAGTACGTTTACTCAAGGAATCGGGAC
TTGCCGCTATCAAGTTGGCTGATTACTATAAGAGCAGAAAAACCATTGATGCAGCAGACAAAGTGTTGACTTTGG
CATCAAGTTTTGGATTGACCCAAGAAATATTGGATATCTTTTGGGCATTTGATCTGAAAATTGCTATAAAAATTT
TGGTAGAATCCAGTCTTTTTGGATATGACTACAAATCTGTTATTGACTCCAAGCTTAAAGATCCACAGGTCAAAA
CATCCATCTATCAAGCATTGTGTGAAGCATTGGACGAGCGGGCCCAAAAAGATTATGAAAGGGGCCAACAGGTTC
AGCAAGCACAACAACTTCAACAGCAACAAGCGCTCCCACCTCATCAAGTTTTGAAAATCCCTACTGTTTATTATT
TACTTGAAAAAATCAAATCGAGTAATGGAGTTGTTGATGCTAAGACCTTGAGAAATCTTCAATTATTGTTGTTAA
CAACCTATCCAAGGTTAATCAATTTCGGAAATGGTCATGATGAAGCCATTTTGGCCAACGAAGAGAAATCTCCAT
TCTTCCCACCTTCTGTTGAAATGGAAATGAAAGCTTATTATTCGAAAATGTATAACAAAGAGCTTGAGATTAAAG
AAATTGTTGACATGTTGACTCAAATGAAGGCCAGCGATGATCTCCACAGTCAAGATGTCTTTGCATGCATGATCC
ACTCTTTATTGGACGAGTATAAGTTTTTCTCAGAGTATCCATTGTCAGCATTAGCTTCAACATCCTTGTTGTTTG
GTGCACTTTTAGAAAAGGATTTGATTCAAGGTACGACTTTAACTGTTGCATTGAATTTTATTTGGGAATCTTGTA
ACCAACCGCAAGATTCACATTTGTTCAAATTTGCGGTACAATCATTGTACAACTTCAAATCAAGATTGCATGAGT
ATCCAATTTATTGTAAACACTTGTTGGAATGTCGTTCATTATCTGCGCATGCCAAGATGTACCAAATAGTGAAGG
ATGCAGCTAATGGTATTCCATGTACCACTGGTGCAGCTCCTACTCAAACTAATACACCAGATGTTGGCCCAAAAT
ATCAGTCTATTAATTATGTTGATAGAACTATAGGTTATGCAACCCAAGAAGAACCACCAGAGTCTATCAGAGATA
AGTTATTATTCAGTGTCAACAATATGACAGGTGAAATCTTAGATTATCTGAGATCCAAGAAGTATTGACTGAGA
GTTATTTCGCATGGTTTTCAGATTATTTGGTATCGACAGAGCCAAGGCAGAACCAAACAACCACGAATTATATT
CCAAGTTGGTCAAGTCGTTAGCAAATCCAATCTTTTTTGAGTATATTTTGAATGTTTCTTTGAAAGAGGTTGATT
ATATTATCCGTAATTTTAAGGATTCAAGAAGCGAAAGAAACCAACTAAAGAATTTAGGTGCTTGGTTAGGACGAA
TCACATTAGCCAATGATAAACCATTGAAGAAGAGATTATATTGCCTTGAAGTTTTTATTAGTGGAGGCGTACGATT
TCAACTCGTTGCCATTGATTCTTCCGTTTGTGTGTAAAATCTTGGACCAGGCTCAATATTCAAAAGTGTTCAAAC
CACCAAACCCTTGGGTTGTTGGGGTTATGAAGGTTTTAGCTGAGTTGTATGAATGTGCTGATTTGAAATTACAAT
TAAAATTTGAAATTGAAGTGTTGTTGAATTCATTCAATATGAAGATCAAAGATATCGAGCAAAGTACTATTATTA
GAAATCATAATCCTGAACCAACTGCATTAGCAAGAATGTTTGGTATCAGTTCACAATCAGTGAATTTGGCAAATG
AAATGACAAGATTGTCTTTAGAGGGCTCGCAATTGGGTAATAATATCCAAGCACCATTCCCACAACAAATTATTG
AATCTAAACAGTTCCCAGGAATCTCCCAACCACAGATGCAAAATGTTTTACAACAGCAACAACAACAACAACAAC
AACAACAGCAGCAACAATTACCACCGCAGCAACAGCTTCCAGGGCAGTTGCCACCTCAACAACAAGCGGAACCAG
```

```
CTTTGGATACCAGTTTCAGCACGTTAATTGGGAACTCTATTTTCACTCAGCATGCAAATTTGCGCAGAGCATTTC
AAGCATCTTTATCTCGTGCAGTTAGAGAATGTACTCCACACATTTGTAACAAAGTTGTGGAAACTGTTGTTACCA
CCACCAAAGCTTTAATCACTAAGGATTTTGCTACGGAACGTGATATTGAGAAATTTCGCAACAGTTATCAGAAAT
TGGCATTGCTGTTGTCTCATGCAATGGTGTCATGCAATGGAAGAAAAGCATTAGTTGAAACAATCGAGGCTACTA
TGTTGCAGTTATTGGGCAACAATCCAAATGAAGTACCTTTAGCTGAATTGAATAGTGCCATTCAAGCCAATGTTG
GTTTATGTGTTGATATTGTTGATGTGTTGGTAGGTGAAAGTATTCTTGACATCATAGAGGCAAGAATGCAGACAG
AAGTGTTTTGCGTGAACATCATACTGCCACAGCTCCAAATGAACCATTTATTGCAGAAGGGGCCAGTGATTACT
CGTTGAGATTACCAAATCCTTTAGGATTAGCACTTACCGGATTGAGTGCACAGCAATTGAAGATTTATGAACATT
TTGGAGAAGCAAGAGTGGATCAAATTGTACCTCCTCCAGGAAGTACCGGTATAACACAACAACAAACACAATCAT
TAGCACCATTACAACAGCAACAACAGCAACAGCAACAACCAGTATCTACAGTAGTAGCGGCAGCACCAG
CACCAGCGCCACCACAACACAACAACAACTGAAAGAACGGCATTGCACAAGCACAAGGTGTTCCTGATGATATTG
TTTCGTTTGAACAATTGTTTACTGCTATTACTGCCAACTGTGACAAAGCCGTTCAACTTGTTTCTGAAGTCACAG
AAACCAAGTTAGCAGATTTGCCACCAAACCATTCCATTATGGCGGCATTGACTCAAGCTTTGGTGATTGCACAGA
CCAATGCCATAAAATATCCTGAGTTGTTATTAAAGGCTGCACAATATGCAGTCAACTGTTTGTTTACTCAGACAC
ACGAAAACCCAATGAGTAATGAAATCTATGTTGTTATTTTAGACAAATTGTGTGAGTATTCACCTTCTACCGCCA
AAGATGTTATTTGGTGGCTTGTACACTCATCTGATCAACGTAAGTTTAATATGCCAGTTATGCTTTCATTATTGA
AAGTTCAATTAATCCAGCCAATTAAATTAGATTTATCTATTGGGAAATTGATTAAAGAAACAAATAATCCGGTTG
TAGTAAAGTTTGCTGCTAGTTTGTTGACGAATATTTTTACTTCCGAAGAGATGCGTCCTATTGCGTTACGATCGG
AATTTGCTAATACATTAGATGCCTTATCTAAATACCAAGCAAATGATCAAAGTGAAGAAGACAGACAAGCAAAGG
AGGCAACTAGTACATTGTTCAAACTCTTGAGTGAGGCAGCACCCCGCTTCAAACCAATTATTTGCTCAATTGGGTT
ATATATTTGCTGAATGGGTAAGATTGTTGACTCATGGAGACGATGCAACAAATGAATTACAAATTGAATTTGTCA
AGGGATTGATTCAATCTGGTATACTTAATAATCCTGAATATGTAAAGACTTTTTTCAAAGCGGCCATTGAGATTT
CCATTACATCGTTTGCCACTGAACATGAATTACGTTCAAGAACTCAACATGAAACATACTTTGCCGTTGATACAT
TGGCTATGTTGATTGTTCGAA
```

YLR038C_homolog_1 74aa PathoSeq: 1..74(SEQ ID NO 668)
DPATFKFETPQFDPRFPNQNQSKHCAQAYVDYHKCVNVKGEEFEPCKIFFKTFTSLCPLDWVEKWDDQRAAGKF YNL131W_homolog 15251bp PathoSeq: 1..15251 (SEQ ID NO 669)
```
TTTAAATCACCAAAAAATGTATCAATATTTTCTGAACAGATACAACAACAACAACAACAACAAAAATTGTGATAA
ATATTAATCAAATTGATATTCATTTTAGTAGAATTGATGAGAAAAAGAAATCAAAGGAGAATTCTCATCCTGGTA
TTAAAAATATATCTATAACTAATGATACCAATAAAGATCCCAATCCTAGTAATGGTTTAATAAAATTAGCAGGAC
AAGAATTAGATTTAACATTTGTTGATTCTGCTAATTTGAGTTTCCCAGGAGAAGACAAAGATAGATCTCATATAT
TACTTCAACATGTTCAATCAGTTACAAATTCCGGTCATTTTCAAATAGATCTGATTAAACTTCAAATAACTATTC
AATTACAACGTAAAGAAAAATGTATCAATTTGAATAAAATTGAACTTCATCAAGATTTTTCAAACATTACCAATA
TTGGATGTTATCAAATATCATCAACTAAACAATGTAAAATTCGTTTAGATTATCCAAATAATGAAATCAAAATAT
ATCCTGTGAAACCAGATATTAATATTAAACCAAAATTACCAATCCATTGTTTTTATACCTGGTGAAAAATTATCTA
TCCCATTGGAAATTAATTATAAAAATCCTCATCATCATGTAAATAAACAAACTTATCTCATGGCAAAAATAAAAT
CCCCAAGTACTGCTACTACTGCTACTAATGATGTGGTTGCTATTAATTGGGATGGATTTAAAGATGATGAACCAT
TAAATTTAATCAATTTACAAGAAAATGATAATATTCATACATTATATATTTCACCAGGAATTGGAATCAAGAAT
ATTTAAATATTGAATTACAAACTTATACTGAAAATGAAAATGAAAATGGAAATGAAAATGAAGAAGAAAATGACA
AGGACGAGGATGAGGATGAGGATGAGGACGAGGTTGTGGTTTATGATATTGCAACTTTTACTATACCAGTATTAT
CAAAGCCATTTCTTGTCAATATGTTATAACTCCAGATTTCCGTGATAAAGCCACTGATATGCCATCACCATTTA
TATTACCTAATAAAACTGATCATAATATGCCTATTGCCGTTAGATTATGGGAAGGTAAATTAAAAATCATTGATG
AATATAAAGAATTTATGGAAGAAAAGTTTAAGAAATAACAACAACAACAACAACAACAACAACTTGAAATTG
TTGATATTGAATTTAATATTGTTTCTAAAAATCCTGAATTAATCATTCATTTAATAAATAATGATACCAATAATA
CTATTGAAAATCAACAATTTATAACAAGAAGTAAAAGTGGATTTAGTCATAGAAATGTCACTGTTGTTAGTTCAG
CTATTATTAAATGGAAACGTAGGAATCATAATGATAATGATAATGATGATGATGAAATAATTAATGAATTTGAAA
CTCCAGAATGGGAAATCACTTTACCATTATCTGAACCAAGAGTTTTATTTCGTATTATTGAACAAGAACAAGAAC
AAGAGCAAGAGCAAGAGCAAGATGCTAAACACAATAATGGTTATAAATTACAATATATTTTAGAAAATCCAACTC
CGAGAGTATTTACATTTACTACTCAATTGACTGATTATGAAGATCAATGGATATTCAACAATTCAAAAAATATTG
TTCCCTTGATCCAACCTCCATTCCCCGTATTACCATTTAGTCGACATTATATGGATTTCATAGGTGAATATTTAC
CAGCACTGGAAGGTATGAGTGATTCTAATTCCAATTTAGGGTGTGGGTCTGAGTCTGGGTGTGGGTTGGGATTGA
AATTACCTAAATTTAAAGTATTTGATGTTCAATATAAAGTGACACTTCCAATTGTATCAGTTCTGAAAGATATCA
CCAGCATACCTAAGAATACTGGGAATTTATATTACAAACCAAAATAACTAAACTAATAATTCTCTTTGTGTTTAT
ACATTTTCTAGAAAAATAAAATAATTACACATATATTTATCAATAGTGGGTCTGGTCTGGTCACACACATAATTA
TTGACCATTAACACCAAGTAATTCAACTTCGAAAACAAGAGTTTCATTAGGACCAATAATTGGTGGGATACCTCT
TGGACCATAAGCCAAATTTGGTGGAATAGTTAAAATTGCTTTAGTTCCCTTTGAAATTTTAGGTAAATTAGCACC
ACCTTTACCATAATTGTTAGTTAAAGAAATATCCCAACCTTTAATAACTTGACCAACACCAACAGTACAAGTAAA
```

```
TGGTTTACCTCTTTTTCTTGATGAATCAAATTCTTTACCATTAGTTAATTTACCATCATAATGAATGGTTACAGT
ATCACCTGGCTTAGCAAATGTGGTGTTATCACCTTCTTGAACAATTTCAATTTGTGGAAGTTCTTCAGACATTGT
AATTTAATCTAATTTAAGTTAATGAAATAATTGCAAATAATAGTTATATGTGTCAATTGAATTGATTATAAAGTG
GCAATTAAAAGAATGAATGAATGAATGAATGAATGAATGAATGAAAATGGCTGGGAGAGAAAAAAAAAAAATTTA
TTAGTTGAACGGAAACGGAGCACGACACACACACACACACACACAATATTTGTCCAACACACGACTATGGCAACA
AAAAGATTCATTGCCACCATCAATAGCCCGAATTTAAAGAATATAATGGAAGTTGGGGACAATTGTTATTTATAA
TCTTTCCTTTTTTTCCAATCTACAATAACAATAACTACCATCCATTCCTTTTTTGGTCTATTGAATTAAGATCA
TTTTGTATAATATCCATCGGTTAACTCTTTTTTGACCAAATGTTGAACTATTGTTTAGTTTGTTCGTATTCATTT
TTTTTTTTTTTTTTTGCAACTAAACAATAAAAGATCTTACAACTTAGTGGTGGTTGATCTTGTGGTATGATTGT
TATTTCTATTATGATGGATTGAATAGTTATTGTATAATACTCTTTCTTAGCAGACTTCAAAGTAATTTCTTACAA
TTGTTTAACTTGCGTTGTAGGTGATAATACTCACTTTATTAAGTTTATACAGCTAGAAACTATAAATCCCAGATC
TGTTTATCTAATAATGCCATATGCAACAAAAACTGTTTCAACCGTTTGGTGACACCATTTGATGTGTTATACTGA
TAAGGGGAGGTTATTTAGAGAAAGAAATCTTTAATATATATTTAGTTGGTTATTCTTACTTGATGATGCAGCAGT
GGCTTACACTAACCGCAGCAGCAGCAGCAGCAGCAGCAGCAGCAGGAGTCACTACTGCGCACGCGCGCACTC
CATGACACTAACTATTAAGTAAATAAAATAAAAAATTGGTTAAGAGTAAACTTATCTTTGAATTTCATGTTTTCC
ATAAAAGCAACAACAGCAACAGCAACAGCAACAGCAACAGCAACAACAGCAACAACATTTTCAATAAACACAATA
ACCCCTTAACTTCTTATCATTTATCATTTATCATTTGTTCATCTCAAAACACACTGTATCTGATTTCAACGCACC
CTTTTTAACTTAATATGTCCGATGTTAAAATTGAAATTGATCGTTCACATACTGATGGAGCTTTCACCAATTATG
ATATTATTAAAGGAAATGTCACATTAGTGGTTACTAAAGCCATTACCTTAAATTGGATTCAAGTGAAATTAGAAG
GTGAATCAACGACGCAATTACTGATACCTAAATTTAATAACAATAAGAAGAAGAAAGAAAAGGATAAAATCATTC
AAGATATTCATAAAGTATTATATGATACAACAATAGTTTTCCCACCAGATAATGTTCGTCAAGTTAGTCAAGCTA
AAGAATTTACTTTAGCCCCAGGGAATTATTCATATCCTTTTGAATTTAAAATCCCTTTAACTAATTCTTGTGTTA
AACGTGGAGGGATCACAAACATGATTCATATTAATAAGAAAACTTTTGATATTATGATTAATAATGGTAATTTCA
ATAGTGATTTTGTTAAACATAAAGCTCAAAAGTATTATAAAGATTATGTGGCGGGTGGGCAACAACAACAACAGC
AACGACCAGAAATGCCTGCCCTGCCAAATGAATTACCTTATCATGTAACTACACAATTACCACCATCATTATCAG
GGATGGGGAATTTTGCTAATATTAAATATTATGTCAAAGTGACATGTAAACGATCATCATTTTTAAAACCAATC
TACGAGCTTTTGATCCATTTACATTTTTACCATTAGATCTTGATTCTCAATATCGACCCATAGAAGAACAATTGG
AACAATATAAAGAAGCATTTGTAAGAAAAGAAATTATATTTATGAATAAAATTCCATCCATTGTTGGTGTAGAAG
TACCACAGAAAACACAACTAGTATCACAGGCATCACAGGCATCACAAATACAACCTAAAAAGCAAGGATTCTTAC
AAAGATGGTTTAGTTCTGATTTAAGTTATAATACACCCAACAATAATACTTCTGGACATATGTCAAGGAAAAATC
AACTGATGAAATATCCTAAGATTACACCAGTTAATGTTCCATTTTCATTTGAAATTAGATTTCGACATCCTGCAT
TTTTAACTCCTGGGAAACTGCCAACTTTTAAATTATATCTTGTATCAACCGTGAATCCATTACAATATTCATTAG
ATAAATATGGTGAACCAGAAGAATCTAATGGATTAGGAGTTGTTTATTTACAAAATATTACTGTTTCATTAATAT
CTACAACATCTATATCAATTGTGGAAAATGATTCTGGTATGAATGAATTTCATATGGGGAATAATGTACAAACAA
TACCAATTTGTGATAATTCTTATTCTAATTTGAAATTTGATTTAATGAAATGTCGTAAAAATAAAAATTCCCTGA
TAACAACAACAAGAAATTCCAATGATGCTTGTATTAATAATAAACCAGTGACAAAACAACTTTATGAATTAGAAA
TCCCACAAAAATATTTTGCTAATTGTATATTACCAGAGAATTTACCACCAAGTTTTAAAACATGTAATATTTCCC
GTTCTTATGATTTAATAATAACTGCTAAATTTAGTCCTGAAAAGATAACTATCACCACTACTTCATCATCATCAC
CAACAAATTCCGCCAGTAGTAATATGAAAGAAGTTGAATTAAGATGTTCAAATATTAAAGTATTAAGTGGATTAC
ATTTTGCTGGTGCTCCAATAACTCAACGACAAGCTAGTGTGATACTGTCATTAACTCCACCACCAGCACCAGCAC
TAGCACCAGCAGCAGGATCAAGGTCAGGGTCAGCACCCGTGGCAGAAACACAAGATTCCTTAGGACAATCATCTA
AAAGTGAATCGTTCACAAATGAAGGAGATGAAAATTTACCAACTTATGATGAAGTAGTTATAGAACATAATTATC
AAGATATAAGTGAACATCAAAGAGCCAGAAGAAGATATCAAGAATTTGGTATATAAGAGGGAGGGAGGGAGGGGG
GGGAGGGGCGAATTTATATATTATAGTTTATATGAATGACGTATAACAATCAAAACTTGAATTATATATATTATG
TTGTTGTAAGTTGTTATGTCAAGTAGTAGAATTTAATCTATATTATAATTAGTGTATGAAGTGTGGATGCTACCA
ATTAATGGTCTATTTTACACTACCACTCCTAAATTTTTAAGTTTGCTGTGTGAATTGGCTAATCGACCAAAGTAC
ACGTCCTCCAATTTGTTCTTTCGCTTTCGCTTGTTCCCAGAGGAAAGAAAGAGAAAATTTTTCAACCAATCCAAT
TACAACGAATAGTCTATTCATTCATTCATTCATTCATTGACAATACTTATTACTTTTCTTTATAGTAATTTAAAG
AATCCAATTCTTATAACATCCAACTACTATTGAAAGTTTTTTTTTTAAAATTATTCAATATTTGAAATAAAACT
TTCTACATTTATTTTTTTATTTTTTTTTTTGATACAAAGGAAAGAAGGACAGAATCAACACCACTACTACCCTC
TACCCCTTCTCCGCTCCAACTTAACAATCATGTCATCAGATAATTTTTTTATAAAGAATAGAACTGCTATTATTG
TGACTGCATTGACTGCATTCTCTGCAGCTGGTGCTTATTATTATTACACTCAACAACAATCAACTGGTGGTTCTA
ATTCATCTTCAAAATCAAATAAATCTTCTAGTGAGGAAGGTAATACTTCCACTTCTTCCTCTTCTTCTTAAGAAGA
AGAAGAAATCAAAGAAGTCAAAGGGAAGTGCTACTCCAGAACCAACCAATTCTACTTCTTCTTCTACTACTACTA
CTACTACCACCACTACTACTTCTTCCTCTGACAGCAAATCAACTTCATCTAAGAAAATCAAATATCCAATTAATT
CTGAAGGATTACCTGAATTAACTTCCGATATTATTTCTAAATTATCAGAAACTGAAAAGAAGAATGGGCTATGC
AATTAAAAGAAGATGGGAATCAAGAATTTAAAAATAAAAATTTCAAAAAAGCTATTGAATTTATAGTGCTGCTT
TAGAATTAAAACAAGATCCAATATATTATTCTAATAGATCAGCTTGTTATGCTGCTTTAGATGATCATGAAAATG
TTATTAAAGATACTACTGAAGCGATAAATTTAAAACCAGATTATACTAAATGTATTTTAAGAAGAGCTACTTCAT
```

```
TTGAAGTTTTAGAAAAATATGAAGATGCCATGTTTGATTTAACTGCTTTAACTATTTATGGTGGGTTTTCTAATA
AATCAATTGAACAAGTTTTAGAAAGAGTTTTAAGAAAACATTCGATTAAAATTGTTGAACTGAAACCTAAAAAT
TGATTTTACCATCAGCTGCTACTATTGGATCATTTTTTGGTGCTTTTGTTGAAGAAACAGAACCTGAAGGAATTA
ATGAATCTCATGAAAATGAAGGAGTTAAAGCATTATATACTGCTTTACAAAAAATTAATGCCAACACTCAAATG
GTTATGAAGAAGCTGATGAATTGATTTCTAAAGCTGTTACTGAATTGGAATCTGCAATTGAATCTGCTACAGAAT
TAAAACCAGTTTTGGCAATTGCTTTAGAATATTTAGCTGCATTCCAATTTTTGAAAAATGATCCAGTTAGTGCTG
CTGAATCAATTGAAAAAGCCATTTCATTAAAACCAAGACCAAGAGCTTATGTATTCCGTGCTTTAATTAATGCTG
ATAAATCATCTTATGAAGCAGCATTAAAAGATTTTAAAACTGCTGAAGAATTGGATGATAAATGTCCTGATATTT
TCTATCATTTAGGTCAATTATTTTATTTAACTGGTGATTTAACTAATGCTGAAATTAATTTTAATAAAGCTAAAG
AATTACATCCAGATAATGTTTATGCTTATATTCAATTAGCTTGTATCACTTATAAAAATGGACAAATTGAATTAG
CTAATGAAAAATTCACTGAAGCTAAATTAAAATTCCCAACTTCACCAGAAGTTCCTAATTATTATGGTGAAATTT
TAGCTGATAAAGGTGATATTCAAGGTGCTTGTAAACAATTTGAAATTGCTTCTAGATTACAAGAAAAACTCGATA
GATTTTCTGTTGGAGCATTACCATTAATTAATGAAGCAACGGTTATATCTAGAGAATCTTTAGAAAAAATTGGTG
AAGCTGAAGAATTATTAACTAAAGCTTGTGCTTTAGATCCAAAAAGTGAATTAGCAAGAATTTCTTTAGCACAAA
TTAAATTACAAAAAGATGAAGTTGATGATGCTATTGTATTATTTGAAGAAAGTAGTGATTTAGCAAGATCAATTG
AAGAAAAAATTCAAGCTACTTCATTTGCTGAAGCTACTAAAATGCAAAAAAGAATTAAAAATGATCCAATTTTAA
ATAATAAAATTGCTGAATTAATGAGACAAAGTGGTGCCATGTAAAGAAGAAGAGCCTGCCTGCCTACCTCACTCA
CTTCCTTCCTTCCTTCCTTCCTGAGAAATTCTTATTATAATTAAAGGGGGAGGGTTTATAAACAAGATTG
GTTAATTGTAATTTCCCCCTTTATTTTTTGTAAAGAAGAATAAATTTGTTTTGTATATAAAAATTATTATAGTAG
TAGTTTTTTTTGTAAATTTAAATTACTTACTTACTTACTTACTTACTTACTTGCCTATTAACTTTTTTTCTTTTT
TATATTATTTGTTATTATTTGTAATAAACATATTTTATTTACTCCATTCATTCAAGTTTATATCTATTTTATCAA
ATGATAAGTTAACCCCCTTGTGATCATATGTTATTTATTAAATCATTAATTCGTTCAATTATTGCATCACCGAAA
AATCAATATTATGATTCATCAACAAATTTAAAACTTGATTTATCTTATATTACTCCACAATTAATAGTAACATCA
CCACCTGTAACAAATTATATTGAATCATGGTATCGTTATCCTTTAAATGATTTATTACAATTTTTAAATTCTAAT
TATGGATCAAATTGGCATATTTTCAATTTTCGAGGTGAATCTCCTGGATATGATGATTCATTAGTATATCGAAAA
GTTAGTCATTATCCATTTCCCGATCATTATCCACCCACTATGAATATTATAATTAATTGTATTGATGAAATTGAT
AATTTATTACAAGTTTTCGGCGATAAGACTAATGTTGTTGCTGTGTTACATTGTAAAGCAGGCAAAGGTAGATCA
GGAACTTTATGTTGTGCATATTTGATCTATCAAAAATATCATAAATATCATCAGTCTCATAGCAACAAATCATTC
ACTCTAGAGGATATTTTATTGATTTATACAACTAAGAGAATGAATTATTTAATTGGAGGAGAAGGTATATCAATA
ATATCTCAAAAAGATATCTTCAATATTGGTATGATTATATTCATAATAAACAATTACGTGAATCATATATAAAT
TGGTTAAATATTATGAAATTTATAAATTTAAAAATCATTCGAATAGGTGGATTGAAATTATCTAATATTGATTAT
TTAAATATATCAATTCTGACATATATTACAAAAATAGAAACTGACACTAGTGGTAATAGTAATAATAGATCAAAT
ACAATTGTTAAAGAATTAATACAATTAACAAATGAGAATTGTGATATTGATAACCATGATGATGGCCACGATGAT
TATTGGATAACTTATAATATTCATGATTTGAAGATTTTCCAATTGGAAGATATAATGATTGGAATTCAATCATGG
AGTTATATTTGGTTTAATATTTTCTTTGAATCATTTAAATCAAATGGTCATGGTCATGGTCATCACAATAATAAT
AAGGTTTTATTCAATTGGGATGATGATATAGATGGATTTAAAGGATTTAAACAAAAGGGAATAAAATTATTTAAT
GAAATAGAATTACAATGGGATGTTATCATCACCACCAAAAGTACAGATATATATGCTAATTAGATTATTCTATAT
ATATATATATATATATAGAAGCTTTTAAAAAAAAAAAAAAAATAATCATAATAAGGTTTACTCATTTCAA
TTCTTTAACCTCCACGTTTTTCATTATCAATTTCTAACCAAAATTGATTCAATGCTCTTTGTATAGAATCTAAAT
GTTTTTTACCATTTTCTTTAATGATTTGTATATTTGATTTAATATTAGTGAATGGTTTAATGATTTTGATTTCAT
TAAATATAATGATTTCTGATTGTTTAGTAGATGTAGTTGAATTATTGCCATTACCAAATTTAACATTTTTATCTC
CATATAATTTGACAAGTCTATTGAATAAAAGAGTTGAAATATTGGATGGTTGGGTATGTGATGCTTGTTGTTGTT
GTTGTATTGGTTGTATTGGTTGTGGTTTATAATTATTGATTTCATGATTTAGTCTTTTATCTAAATCATCAATAT
TTATAAATTCCAATAATGTAGATGCAGATGATGAAGAAGAAGAAGAAGATGAATCCGATTTATTATTACCATTCT
TCCTTGAAAAAGGTGGTAATACTTGAATACTTTTAATAAATGCCGTATTTATAATTCTATAAGTTGAAGTAGAAC
TGGAGTTTTGTTTATTATCATAATATATTGGTTTTAGTTCTAATAATTATAATTTCATTAGATGATGAATAAGTAT
AAATTTGACCAATTATTATTTGATCTAATAATGTTATGATTTTAACTTTTAAATTAATGATTTGATCAAAATTTT
GAAATGACATGATTTGTAAAAGTGTATAAATTGTATTAAGTAAGTAAAATAAAAATTGACTTGACTTGAATTGAA
TTGAATTGAATTGAGCTGAGTGGTTGTTGTTGTTGTCGTTGTTGGATTATTGATATGGATAGGATTA
TTAAATATTTCAGAATCAATAATTAATAATAATCTTGTAATAACAATTAAATTAAATATGGAATATGAA
TTGATTCTATTAATGCAAAAATTGTAAATTGAATAGTAATTAAATATTAAGAAATGATATTAGATTTTATTTAAA
TTAGAATGAAGTGATAGGTGGGATAGGTGGGTGATAAATAAGGAAAGGGGAAAAGGGAAAAGGGAAAATTTTTTT
TCAGTTCAGTTCAGTTGAGTCAAACTTTCAACTTTCAAATTAAACTATACACACAATTTTTGATTTTGAAAGGAG
AGAGAGATCAACCACCACCATCACCGCCAATGGAGTTTTCAGTTAGTGCGAACTTTTGTACCAGTGTGGTAAGAG
AGCTAACACGATTGGAATGATTACTTTGCACCAATGTCTGGCCATATCTAGTACCACTGCTACCAACTGCTACTA
CCAACCTAACCTCTCCCGACTACACGACACTACACTACTCACACGACACGACACGACACGACAAATTTTGTTTAA
CTTCTTGGTGTCGTGTAAAATTATAAAACTTCCTTTTTGTTTTTTTTACAACCACAATCAATCAATCAACTACA
ACTACATTAATTCAACTTATATTAATGGTCACCTCCCACTTTCCTCTTTAAATGCAACTGGAAGAATTAATTCTG
ATTGATAAATTAGAAGATCAAATCATTGATCATCCTGATGCTTCTACTAAAAAAGATTTAAATGAATCACTCGAT
```

```
GAAACATTTCAAAAAAAATTAAACGCCAGAGCTCAACAAATTAAATCAACCAACAACAATAGCTACAATAATACC
TCCACTAGACAACAATCTAAAGGTCAACATAGGAATTCAAATCAAGATTCTTCTTCTTCTTCTTCTTCTACCTCG
TCAGGTGGTATCAATTATCAATTTCTTATTACTAAATCACATTTAAATTACACATATACTGATTATAATTCATTA
GAACAAGAAATTTGTGAATGGTTTTCAATAAATGATTTTAAATCACTTGGTGGGTTAAATAATCTTATTCTAAAT
TATACTAATGACCTTAACAACAACAACAACAAAGCAAGTATAACTGAATTGATACAAAATTTACACGCCAACCAC
AAAATTGATGATCTATCTACTAATACATTACAAACAATATTATATTATAGTTTTGGTGAATATGGTGATAAAAAA
TCTAAATCAGATCAACTTGATAGTATTAAACGAAATAATTTACAACTCATAAATGATAAACTATATCAACCATTA
ATTAATATAATTCAAAATTTCTTTAATGATAGAATATCTCATGATAAAGCTACAACCAATCACCCAGAATCATCC
ACATTATCAATAAGACAACAAGAACCAATTTATTTTATTATACTTACATTAATGTATTTTATGATTAATGTTAGT
TTATCAATTGATCATGATAACAATACTATTATTAGAAGTGAGTTTAAGAAATATTTGAAAGAAACAGATTTTTTA
ACTTCATTATTAACATTTATTGAACATTGGAAATGGCATCCTAATAATTGTTATCGTATAAGATATTTAATATTA
ATGGTTAATAAACTCATTTTTTTAGAATTGGGTGATTCAAATCATATGAAACAATGTGATGAATTTTTAGTCAAA
TTACATCACGTTAAAAATAAACCAACAAAAAGAATCACTGGAATCAAATTTAACTTGTTCACCATTAGATTATTTT
GTTTTCCGACAAGATTTAATTGATAAATATCCACTTTATGATGAAACTGAATTAAAACCTTATGATTTCCGTAAT
TTAAAAAAGTCGTTGGATAATGATGATGATACTACAAGTGACACATCAAGTATTCATAGTCATTCTAGTACTATT
GAAGGAAAGTATAAATATTTTATGGCATTACACAATTCATCCAATTCTCTTTCTAATTTAATTGAAACTCCCAAG
ACTAATAAATCACATACTATTTTCGGTCAATTACCTACTCAAACAGTACATTTAGCTACTCCAGTACCTTCACCA
ACTTTGGCAGCATCAGATTATATGTCTGGTGGAGAAAAAATTCGTAAATCATATCAAGTTAATCAAGCCATGCCC
ATGATTTATCCTATTACTAACAATTATAACGGTGATGGCGTTATACCATTAGCAATGAGAGAAGCCGATGAAATA
TTGAGAAAATCTATTTATGAAAGTTATTCTATTAAAAGATTATGGAATGAACGAGATTATTTTATGAAACAAGAA
CGGGGATATGCCGATGGGTATGATAAAACTACCAAAAATGATGATGATGATGATGATGATGATAATGATGAATTT
GATTATAATTTTAATGAATTGAGACAAAAATATCCTGAAAAAACTCTGGTGATTGATACTTTAGAAAGAATTGAA
ACTTTATATTCACAAAATTTATGTCGATTGAATACTATAGTTGAAGTTTTTATTGAAACCATTAAAGTGAATCGA
TTAGATTATAATTTAAATTTTGCAGAATTGGAATTAAATTCAAAAACCAAGTCTGGTCATCGTGATGAAACAATT
CAAAAAAAAATTGAAATGGTATTAATACTGCAATTGGAAGTTAATAATGCCAAAGAATTAACGTTAAAAGCCACT
TCAAGTTTAATTTTAAATTTATTAAAATGGTTTAAAATAAGTCATATATTGAAATCATATTATTTTTCATCATTA
TTATTTGATCAACAATTTTTTGCAATTTCTTTAGAATATCTTAGTCGATGTTTTAATAATGCTAATTTACAAAGT
ATGATTACTACTACTAATTCTAGACAAAAAAAGGATGAATTAACTGAATATGAAATATTAATTAATCAAAATAAA
TTAATGAATCCCAAAATATCATTACCAAATGGGAATTTTTTCGATAATTGTTTATGTTTATCATTAACCCATCAA
GAAGTTAAATACAACGATTTTAATTTTATTAATAAAATTTTCATACTGTCATTACCTGATAAATTTGATTCTAAT
AATATTAAACATGTTTATATTTCAAATTTTAATGATAATTTTGCTCATATTTTGAGTGATATATTAAATATTACT
AACAAAATATTAATTAAAAATCAATCACAACGAATATTTACATTTAATGATTTAAAACCTTCAGAATTATATAAA
ATGATATTAATTAATTATGATTGTCAATCATTTAATAAACCAATATTGAAAACTTTGAAAAAATTAATACCTTAT
CAAGGTCGAAAATGGAAATCTTCTAATATCGATTTAATTTAGTCAAATTTATTTAAATTTAAAATTATCAATGAAA
GATAATTGGTTGAGTGGTAAAGATTTAGAAAGTGATTTCAATAATTCTTATGATCAAGAAATTGCTCTTAGAGGT
TTATTACAATTTTATAATATGAGAAATTATCCTTTACAAATGAATAAAATTGGTTATAGAATTAATCATGATATA
ATGAATATTCCTCAATTGGATTTAAATGATATGAATATATATGATGATGAATATGATGAAGATTATTATGAGGAA
GATTATTATGAAGAAGATAATGATGATGATAATAATACCAATACTAATACTAATACTAATACTAATGATACTAAC
GATAATAGTATTCAAGATGGTGAATTCATTTAGTTAACTTAGTGCGTGTGTATACCAAAAATTCCATTCAAAGTA
GCCCAAAAAATTTTTTCTTCTTTCTACAATTTGTGGGAATCAACTTTTCCTCCAACTACAAATTTTTTGATTTG
TTTGTTTGTTGAATTTATAAAAAGTATCATCATTAATAATAATTGTTTCTCTTTATAAGTTATAGACCATGGTTA
AATTAACACAAATTGACGACGAAACTCAACAACAATTTGAAAATCAATCAGTTGCTAAAAACAACCACATTATCG
ATGAAGCTAGTTCTGAAGAAGAATCTGATGATGATGATGAATCAGATCTTGATGATTTTGATTTTGAAAATGAAA
CTTTATTAGAAAGAATTGTTGCTCTTAAAGATATTGTTCCACCAGAACAAAGAGAATCCATATATAATTTATCAT
CAACTATAGGAGATTTATTTAAATCAAGTGTTCAAAATGGTGGGAAATTTTTATGGACATTGACTTCAAGTTCTT
TATTATTAGGAGTTCCTTTAGCTTTAGCAATTTTATCCGAAACTCAATTACAAGAAATGGAAAGAGGTATGTCAT
TAGAAAAATCTGCTCAAGATGTTTTAGCTCCTGGATCTGAAGCTGCATTTGGAAATGAAAATAAGAAATAAATGA
AATAGAATAGAATAGGATCCAATCCAATCCAATCCAAAAGCAAAGTAAAAGCAAATTTTCAACCTTGTAA
ATAAAGATCTTTTTTCAAAAATTCAAAAAAAAAATAATAATAATATACATCTAAAGAATTTATATTTATATTAA
TCTAAAGTAAATGGTAGGATTAAACAAAAAAAAAAAAACACATAATGGTAAGTAAACAAGCAAACAAGCAAACAA
GCAACTAAACAAGCAAACAACTAAACAAGCAAGTAACCAAACAAAACGTATCTCTCTAGTTTATTTTTTTATG
CTTAATTGATAATGCATAAATATCTAAATAAGTAGTGATTTCAGTAATCACTTCAGCAACAAAAATTCCATGAAT
ACCTAAAGTTATTCCACAACCTAACCAACTAATGGCATGTAACACTTTAGCAGTACCATAACCATAAATATCAAT
TAAAATTTTACTCAAAATCAATTGACCAATAGGGACAAACATTGGATATTGAATAAATGGGAATTCTTGTAAAGT
TAAATGAGCCAAAATAATTCTTCCAACAGAAAATGCAATAGTACAACCAATAGATATCACTAATGGGAAACCATA
ATCATAAAGAATTTGTGGATAAATCC
```

YNL131W_homolog 150aa PathoSeq: 1..150 (SEQ ID NO 670)
MVKLTQIDDETQQQFENQSVAKNNHIIDEASSEEESDDDDESDLDDFDFENETLLERIVALKDIVPPEQRE
SIYNLSSTIGDLFKSSVQNGGKFLWTLTSSSLLLGVPLALAILSETQLQEMERGMSLEKSAQDVLAPGSEA
AFGNENKK YHR161C_homolog 4220bp PathoSeq: 1..4220(SEQ ID NO 671)
ATCCAGTTTACTTAAATTTAAATGGACAATTATCTTAATAGACAAACATCCCAGATTATTATCATCTATCTTCAT
AAACTTAAAGGTGACAATGTCCAAAATTTTATTCTTTATCTGATTTGAAATTTATTAAACCCAAAACATTAAAAT
CATGGTTCACAAATGGTTCATCTCCCCATGGTAAATTTTGTGTTGTTGATGTACGAGATTCTGATTTTGTTGGAG
GTCATATAAAAGGCTGTTATCATTATCCTGCAGCCAATTTCCACTACACATTGAATGAATTATATCAAAAAATAT
ATCAGAATAAAATACAAGATATTGTTTTCCATTGTGCTTTATCTCAAGTAAGAGGTCCTTCAAGTACATTAAAAT
TCTTGCGTGGAATTGATGATATAACCGATTCCAAAGTAAAGAGTTATTTCAATGATGACAATATTCAAGTATACG
TGTTACACGGGGCTTCACAAAATGGCAAGAAGAATATGGGAACGATAGAGAAGTGACAGAGGCTTATGACCAAG
AAATATGGGAGTTTGGATCCTAGTGATGTAATATGTGTATATTGTGTTTGATTTTCACATTTCTATTGTACAATT
GTATTAGCAATATCGGGTTATATTTTAGATTGATATAGATGTGTATATAAATATGTATAAATGCGCCACGCAACA
TGTGTACATGCATGTACTACTTCAGCAATCAAATTAAGCTTGGACCATCATGATAGTTATATTGTTGCACTTGCT
GTTGCTGTTGCTGCTGCTGTTGTGGTTGTGGTTGGAATGCTTGGTTGTATAGCCCAGTTTGGGCATTTTGAAAGT
AAAATTGTCTTTGAGCTTCTTGTTGGGTCTCCGGGAAGACTGGAATAGTAGGTAAATGCTCCAATCCACCAGCAG
TTGCTTGTGGTTTCAATTGTTGGTGTTGGTTTTGTTGTTGGGTCAGAGCATAATTATCAAATAACTGCAGGGTAG
TTTGTGATACTTTAAACGGATTATTGCCAGTTGCGTTAGCTTGAATCTTTTGATTTTGTTGTTGTTGCTGCTGTT
GTGGTTGAATTGATCCATTATCCAATGTGAATGCTGTGGTATGACTGGTAGATGCGAATCTTGTATTAGCAAATG
GGTTAGTTGATTGCTTGTAAAGGTTGTGGTTTGTTCAGTTGGTCATATGGTTGAGCAAACTGTT
GTTGTGAAACTTGATGTTGACCTGTTGCCATACTTGAAAATGGGTTTGTATTAGATCTCTGTAACCCTACTGGCT
GTTGTGGTTGTTGTGGTTGCTGTAATTGCGGAGTAGGTTGGATGAATGGGTTTGTATGCTGTGCTTGTAACTGTT
GCGGCTGCGAGCCATATCCTCCAAACCCAACACCAGTAAATGTAGATTGCAATGTTTGACCTTGAGAAATGGATG
GCAATTGTGAAAACAAAGTCTGTTGCTGCTGCTGCTGTGTGGCCTGCTGTGTTGCCTGCTGTTGTAAAGCTTGTT
GTTGAGCCTGTTGCAATTGAACTTGTTGCTGCAATGCTTGCTGTTGCGCTTGCTGTTGAGCTTGCTGCTGAGCCT
GTTGTTGAGCTTGGTCTTGTTGCAGCGGATCCACAACTCCGACAATTGGGACAAACATGGTATTCCACGGATTGT
AGGTCTGTTGCACGACCAATGAACTGTGTCTATTCAAATCACTACTAGTACCTTGTAATTTCTGTTGTTGTTCTC
TTGGTTGTTGTTGTTGTTGGCCCGGTTCATTCTTACTCTTCTTATTAAGTATAGATTGAGTCGGTTTCAGAACAA
TATTGTCTTTCCCCTTTTTTCTGCTAAATATTGTTTTCGATTAATTTCAAAATTTGGATCATCCAAATATTCTT
CCAAAGAACTTGTCAAAGCTGTAGGCGCGTGTTTGATAGTTGGGACGTGTAACTTCGTAGCATACTCCAAATGCT
TAGCTACTCTCAAATAATCAATGACAAACTTGGTTTGATCTACAAATTTTTTGTATATCTTTAAAGATCTTTCTG
CATCAATTTTCGACATTTCAAAATAATGTTCCAAGATGTTTATCACCCCTTCATTCAATTCTTGGAAAAGAGCCA
ACAAATCATTGACCAATAATCTAAATGCAGTTAAGACAATGTCATTATTTATCTCGTTTTCCATGAAATTATTCT
TCAATAAAGAATCAATTTGTTTCTGGACACTTTCAACTTCTCTCAACAAACCTTTGTCCACGTCAAGTAATCTTA
ATCTACCACCTTGCTGATTGGTATTGTTATTTGATCTTTCATCTCTAACATAATCCACCCCGTCGACTCAAATT
GCTTGACTCTGGTGTGTAAATACTTGGCATATCTCGTGATAAATTTGATATCAGAATTGAAACTGTTGCTATTTT
TGATGATGTTATTATTGTTCAAATTTAAAAGATTTGGCGATGCTTGATTACTTAAATAATCTAACGTCACATTTT
TATCCCCTTCCCTAATCATCAAATGAATCACAATCAAGGCTTTATAAACGACAGACCAGGAACTGTCGTGCAATC
GTGCCTGTAATGTTCTCATTATAGTGTTGAAGTTCTCCTTAGAAATAAGGGAATGATTCAACGATGTAGCCATTA
ATATGGCTCAATATATTTTGGTTTAGGGGCAGCCACCTTCACTTTAGTAGCACCCTTGACAATCTTCTCATAGG
TAGTCATTGTCTAGTGTTGTTGAAGTAGAAATATTTGAAAACAAATAATGTTACTCGGCAGCTACTGAAGTGTAA
TAAAAAAAAAGACCCCAAAAATAATTGAAAATGTGGTACAGATAATTCTATTGGTAATGGTTGCCTGCTAGGTAA
TGATCCTTGCAAAGAGTTCTGCTATTTCTTCAATGAATTAACACAACTAACAGAATTGGAAAATTGTACAAGTTG
TGGAAAATATTTAATAATAGTAATGTGTGTTTGAAAATTAGTATAATTTTACTCATGGGCAGTGCGCACAAACAA
ATAAAACCTCAACTCAATAGTTGTCGTCGGCTGTTTCTCCTTGCTTTTTTATGATCTTTGTTTTTCTTTTTTGT
TCCATGTAACGTTGCCGGAGGCTGTACAATTTATAACTGCCCTTGTTAATAGTAGCTATACTTGAATTGGCTAAA
ATAATGACTCGTTTTAAGTCAATTGACACTATACATTTCAGAATATTTAATGATAAACATAAGCAAGTATTATGA
TCATCGACTATGGGGTGTATTCTCATTCGTGTGAAAACCAATCTCGGAAAACAGATTAGATTATCATAGACACCA
TTTTTGAAATTGTCTTTTTTCTATGAGCAGTATTAATAGCATATATGTAATTTGTTTACACTGCCATTGCTAAAT
AATATCAAGTACATATACTTGCTTATTATTGAACATTAGGCACATAATGTAGATATATATTTATCGTCGATTCTA
AAATAAAACTCAAGACACACTATTCACTCTGAAACGGACTTTATGTCTGTTTTGGTCTCTACAAAACGCATCTAT
AATTCACCGGCCCATTCATGTGGCATTGCTCGATAGACGTAAACTTCACCTTTTGTCAAGTTCTTCAAATTTATC
TCACCATCAACAACATATCGTTTACCACCAACATTTTGTTCTAAAACCATCAATTTATCTCCCAGTTTACCAATC
ACAACTGACGTATGATCTGGGGCACCTGCAGATTGTGTGACACCAGTACTTGCATCATAAAACGTACAAGCGTTG
AACTGTAAAATGTCACCTCTTCTTACCTCATCGAGTTGCTGTGAATTGTTGATAAAATAGACTCCATTACCAGCA
TTCCCAATTTGTAATATTGGATAACCATGGATGGTATAACATGATACGAATGCATGATTTCCGCATCCCTTTTGT
AATGCTTCTTTTGCCAAATCCCAACACTCACCTCGTCCAACAGTCTTACCTCTGTGATGTTCACACCAAGATGCT
ATATACTCCCCGAATCTTTGATGGTTAGCAATGAGTTCTTGTTTGAAAGGAATTGTATCGATTGGAGATGGAACA
TATTTCTCAATAACCACATTTACGTTACTAATGTCATTATTACTGTATTCAAATTTATATGTGACTATGGATAAG TCTTTAAGTCTCACAGTTAAAGTTGTAGTACCCTTCCCATAAGAGCCTGATGATGTCGTGTACGAAAACTTGTGA
TTGATTCCATGAAATACTTT YHR161C_homolog 609aa PathoSeq: 1..609(SEQ ID NO 672)
MTTYEKIVKGATKVKVAAPKPKYIEPILMATSLNHSLISKENFNTIMRTLQARLHDSSWSVVYKALIVIHLMIRE
GDKNVTLDYLSNQASPNLLNLNNNNIIKNSNSFNSDIKFITRYAKYLHTRVKQFESTGVDYVRDERSNNNTNQQG
GRLRLLDVDKGLLREVESVQKQIDSLLKNNFMENEINNDIVLTAFRLLVNDLLALFQELNEGVINILEHYFEMSK
IDAERSLKIYKKFVDQTKFVIDYLRVAKHLEYATKLHVPTIKHAPTALTSSLEEYLDDPNFEINRKQYLAEKKGK
DNIVLKPTQSILNKKSKNEPGQQQQQPREQQQKLQGTSSDLNRHSSLVVQQTYNPWNTMFVPIVGVVDPLQQDQA
QQQAQQQAQQQAQQQALQQQVQLQQAQQQALQQQATQQATQQQQQQTLFSQLPSISQGQTLQSTFTGVGFGGYGS
QPQQLQAQHTNPFIQPTPQLQQPQQPQQPVGLQRSNTNPFSSMATGQHQVSQQQFAQPYSQLNMNQQPQPLQAQS
TNPFANTRFASTSHTTAFTLDNGSIQPQQQQQQQNQKIQANATGNNPFKVSQTTLQLFDNYALTQQQNQHQQLKP
QATAGGLEH YDR544C_homolog 1700bp GeneSeq: 1..1700(SEQ ID NO 673)
CTAAAGTCCAAAGTTGGTTCAATTTTTGGCAGAAAAAAGAAGAAGGAAAAATTCACTGGAGCTGATTCAATTGCTG
AAGATGAATCATTATCTGAGGTTTCTTTGCCACCTACAAGAACTAGGAATTCATCGGTGTTGTCTCGCAGTAACTC
AACTAGAAGATCTTTTATTGACCGCTTCCATAGAGATGAGTCTAGCACTGGCATTAGCAGACAACATGAGCAGCAC
CAGCAGCCTTTGAGTGATCCTTTGCCTCACGCAGAGAAGCCTCAACCGGAAATTCCCCAATCACCAGAAGCTCCAC
AGGCCAAATCACTAGAGCCTGTATCAGAAGTACTAAAAGAACTGTTCCCACCTATGCAAAACGGGTCCGAAAGGAA
AGGTGAAAATCAGCAGTCGAGAGTTGATGTATCCTCTCAAACCTTGTCACCAGTTACTCCTACTCACGATGGATTT
GGTGGTTCTGTTAAACCATTACCAGAACCTGTTGATTCTCCAAATGTGATTAAATACAATGACTCGGACGACTCTT
CTACAGAAGAACGTAGAGGCTCGTTACTTGAAAAACACAATTTAGAAGTACAACCTGTATCTTCCCCATTCACTAC
TCAACCGCCAGCACCTGTGCCACACAAGAATCCAGATCTAGACAAAGCAGTGATGGCATTTACTCGTTTGAAGCGGGT
GATGATTCCAACCCAATCTCGGCTACTCCAAGATCCGAGCAAAATGTGTTTGGACAGATGCCAGACCCAAATTTGT
CTCCTGAAAAGACTCTTGCTCCACCACCACCACCTTCGAGAAAAGTTTTGCACCATGAAGAACCAACTGTAAGGGA
TTCAGCTCTTTTCCACAATTTACCTGCTGCCTCCCATTCTGGAAGAGATTCGGTAATGGCTCCATTAGCAAGTCAA
GACAGGGGTCATTCGTTGTTGAAAAATGATTTCAAACACGAAAACTTGGCATCCACCCTCGGATTGAGCTCTTCTA
TTGCTGAAGTCATCAATGCCAGCTTTAAGGATGGACAGTTGATTAAATCACAAGTAGTTGGTGAAGTGGCCTTCAA
TTATAATGGTAATGCTTCCGATCCACTTGTGGTCACTATTCCTAATAGTTTCGATAAAGTACTCGTGAACAAGACT
TTTATTGAGGATTTAGGTCAAAGCAAGTATAAAGTGAACCCAACTTCAATTACGTCTAAAACTCTTGGTGGGTTGA
AATATCTTTTGAAACCAACACAGGTACCAGTGCTAATTCAACAAATATGGAAATTTGAACCTCATCAGTCAAGTTT
GATGGTTAGCATTCGTTCAACTACACCTTTGGTATTGGAAAATTTTGTTGTCTCTGTAGCTTTGAATCAAGACATT
GAAGCAACATCTGCTTCCTCAAAGCCTCAAGGTGCGTTTAATAAAGAGAAAAACAGAATAACATGGAGATATCCAC
AGTCCCTCGCATTGAATGGTGTAGAGCGTTTGATAGCTAGATTTATGACTAATGGATTGGGTTCCGAACATGAGTC
TGGTGTGCAGATTAAATTTCAAGTTAAGGATCCACAAGTCAAGTACTGTAGTATTTACAGTGAGAATGGCGAAGAG
ATTCCTACGTTTAGAAATTTGGTTAGCGGTAGTTATAGTGGTCATCTTTAAGTTATCTGTTTTGAGATTAGTCTCT
TGTTGAATTGAAAAAAAAAAAAACGTGA YDR544C_homolog 548aa GeneSeq: 1..548(SEQ ID NO 674)
LKSKVGSIFGRKKKKEKFTGADSIAEDESLSEVSLPPTRTRNSSVLSRSNSTRRSFIDRFHRDESSTGISRQHEQH
QQPLSDPLPHAEKPQPEIPQSPEAPQAKSLEPVSEVLKELFPPMQNGSERKGENQQSRVDVSSQTLSPVTPTHDGF
GGSVKPLPEPVDSPNVIKYNDSDDSSTEERRGSLLEKHNLEVQPVSSPFTTQPPAPVPQESRSRQSSDGIYSFEAG
DDSNPISATPRSEQNVFGQMPDPNLSPEKTLAPPPPPSRKVLHHEEPTVRDSALFHNLPAASHSGRDSVMAPLASQ
DRGHSLLKNDFKHENLASTLGLSSSIAEVINASFKDGQLIKSQVVGEVAFNYNGNASDPLVVTIPNSFDKVLVNKT
FIEDLGQSKYKVNPTSITSKTLGGLKYLLKPTQVPVIIQQIWKFEPHQSSLMVSIRSTTPLVLENFVVSVALNQDI
EATSASSKPQGAFNKEKNRITWRYPQSLALNGVERLIARFMTNGLGSEHESGVQIKFQVKDPQVKYCSIYSENGEE
IPTFRNLVSGSYSGHL YHR094C_homolog 1653bp public: 1..1653 (SEQ ID NO 687)
ATGTCATTAGATAATTCAACAGAAAACCGTGATTTGGAAGAAAAGGAAGAAATTCCAAAGAACGAACAT
AACGAACAAGGCGAACAAAACGAGAACAATGAGCATATACCTACTTTGGAAGATAAACCATTGAAGGAA
TATATTGGTATTAGTATTTTGTGTTTCCTTATTGCCTTTGGTGGTTTCGTTTTCGTTTTCGATACTGGT
ACCATTTCTGGTTTCATTAACATGACTGACTTTTTAGAAAGATTTGGTGGTACTAAAGCTGACGGTACT
CTTTACTTTTCCAACGTTAGAACTGGTTTATTGATTGGTTTGTTCAATGTGGGTTGTGCCATTGGTGCA
TTATTCTTGTCTAAAGTCGGTGATATGTATGGTAGAAGAGTTGGTATCATGACTGCTATGATCATTTAT
ATTGTTGGTATTATTGTTCAAATTGCTTCTCAACATGCTTGGTATCAAATCATGATTGGTAGAATTATC
ACTGGTCTTGCTGTTGGTATGTTATCAGTTTTGTGTCCATTATTTATCTCAGAGGTTTCTCCCAAACAT
TTAAGAGGTACATTAGTTTATTGTTTCCAATTGATGATTACCTTGGGTATTTTCTTGGGTTACTGTACC
AGTTACGGTACTAAGAAATATTCTGACTCCAGACAATGGAGAATTCCATTGGGTTTATGCTTTGCTTGG
GCCTTGTGTTTGCTTGGTGGTATGGTAAGAATGCCAGAATCTCCACGTTACCTTGTCGGTAAAGATAGA

```
ATTGACGATGCTAAGATTTCACTTGCCAAAACTAACAAGGTTTCTCCAGAGGACCCTGCATTATACCGT
GAACTTCAATTAATCCAAGCTGGTGTTGAAAGAGAAAGATTGGCCGGTAAGGCATCTTGGGGTGCTTTA
ATCACTGGTAAACCAAGAATCCTTGAAAGAGTTATTGTTGGAGGTATGTTGCAATCATTGCAACAATTG
ACTGGTGATAACTATTTCTTCTACTACAGTACCACCATTTTCAAGTCTGTCGGTTTAAATGATTCCTTC
GAAACATCTATTATCCTTGGTGTCATCAACTTTGCTTCCACTTTTGTTGGTATTTATGCCATTGAAAGA
TTGGGTAGAAGACTCTGTTTATTAACTGGTTCCGTTGCCATGTCCATTTGTTTCTTAATTTACTCATTG
ATTGGTACTCAACATCTTTACATTGATCAACCAGGTGGTCCAACCAGAAAACCAGATGGTAACGCTATG
ATTTTCATTACTGCACTTTATGTTTTCTTCTTCGCTTCTACATGGGCTGGTGGTGTCTACTCCATTGTT
TCTGAACTTTATCCATTAAAAGTCAGAAGTAAGGCTATGGGTTTTGCTAATGCATGTAACTGGTTGTGG
GGTTTCTTGATTTCCTTCTTCACTTCATTTATCACTGATGCTATCCACTTCTATTATGGTTTTGTGTTT
ATGGGCTGTTTAGTGTTTTCCATTTTCTTTGTTTACTTTATGATTTACGAAACTAAAGGTCTTACTTTA
GAGGAAATTGATGAATTATACTCTACCAAGGTTGTTCCATGGAAATCAGCCGGTTGGGTTCCACCTTCT
GACGAAGAAATGGTTCGTGCAAAAGGCTATACTGGTGATATCCACGCAGATGAAGAGCAAGTTTAA

YHR094C_homolog 550aa (SEQ ID NO 688)
MSLDNSTENRDLEEKEEIPKNEHNEQGEQNENNEHIPTLEDKPLKEYIGISILCFLIAFGGFVPGFDTG
TISGFINMTDFLERFGGTKADGTLYFSNVRTGLLIGLFNVGCAIGALFLSKVGDMYGRRVGIMTAMIIY
IVGIIVQIASQHAWYQIMIGRIITGLAVGMLSVLCPLFISEVSPKHLRGTLVYCFQLMITLGIFLGYCT
SYGTKKYSDSRQWRIPLGLCFAWALCLLGGMVRMPESPRYLVGKDRIDDAKISLAKTNKVSPEDPALYR
ELQLIQAGVERERLAGKASWGALITGKPRILERVIVGGMLQSLQQLTGDNYFFYYSTTIFKSVGLNDSF
ETSIILGVINFASTFVGIYAIERLGRRLCLLTGSVAMSICFLIYSLIGTQHLYIDQPGGPTRKPDGNAM
IFITALYVFFFASTWAGGVYSIVSELYPLKVRSKAMGFANACNWLWGFLISFFTSFITDAIHFYYGFVF
MGCLVFSIFFVYFMIYETKGLTLEEIDELYSTKVVPWKSAGWVPPSDEEMVRAKGYTGDIHADEEQV YBL099W_homolog 1344bp public: 1..1344 (SEQ ID NO 717)
ATGGCTTTGAACTTGGAAGCTGACCAAGTCGGGGTTGTGTTGTTCGGTTCTGATAGATTAGTCAAAGAA
GGTGAAACCGTCAAGAGAACTGGTCAAATTGTTTCCGTTCCAATTGGTCCAGAATTGTTAGGTAGAGTT
GTTGATGGTTTAGGTAACCCAATTGATGGTAAAGGTCCAATCAAGGCTGCTGCTTACTCCAGAGCTCAA
GTTAAAGCTCCAGGTATTTTACCAAGAAGATCCGTCCACGAACCAATGCAAACCGGTTTGAAATCTGTT
GATGCTTTGGTTCCAATTGGTAGAGGTCAAAGAGAATTGATCATTGGTGATCGTCAAACTGGTAAAACC
GCCGTTGCCTTGGATGCCATCTTGAACCAAAAGAGATGGAACAATGGTTCTGACGAAAAGAAGAAATTG
TACTGTGTTTACGTTGCCGTTGGTCAAAAGAGATCCACTGTTGCTCAATTGGTCCAAACTTTGGAACAA
CACGACGCTCTTAAATACTCTGTTATTGTTGCTGCTACTGCTTCTGAAGCTGCTCCATTGCAATACATT
GCTCCATTCACTGCTTGTGCTATTGGTGAATGGTTCAGAGACAATGGTAGACACGCCTTGATTGTCTAC
GATGATTTGTCCAAACAAGCTGTTGCTTACCGTCAATTGTCATTATTGTTGAGAAGACCACCAGGTAGA
GAAGCTTACCCTGGTGATGTTTTCTACTTACATTCCAGATTATTGGAAAGAGCTGCTAAGATGTCTGAT
GCTTACGGTGGTGGTTCTTTGACTGCTTTGCCAGTTATTGAAACCCAAGGTGGTGATGTCTCTGCTTAT
ATTCCAACTAACGTTATTTCCATTACTGATGGTCAAATTTTCTTGGAAGCTGAATTATTCTACAAAGGT
ATCAGACCAGCTATTAACGTCGGTTTGTCCGTCTCCCGTGTCGGTTCTGCTGCTCAAGTTAAAGCTATG
AAACAAGTTGCCGGTTCCTTGAAATTGTTCTTGGCCCAATACAGAGAAGTTGCTGCTTTCGCTCAATTT
GGTTCTGATTTGGATGCTTCTACCAAACAAACCTTGAACAGAGGTGAAAGATTGACCCAATTATTGAAA
CAAAAACAATACAACCCATTGGCTGCCGAAGAACAAGTTCCATTGATTTTCGCTGGTGTTAACGGTTTC
TTGGACAATGTTGCTCTTGACAGAATTGGTGAATTCGAAGAAGCTTTCTTGGGTCACTTGAAATCTAAC
GAAACTGGTATCTTGGATGCTATTAAGACCAAGGGTGAATTATCTAAAGATGAATTAGAAAAATTGAGA
AAAGTCACCGAAGAATTCGTTGCTTCTTTCTAA YBL099W_homolog 447aa public: 1..447 (SEQ ID NO 718)
MALNLEADQVGVVLFGSDRLVKEGETVKRTGQIVSVPIGPELLGRVVDGLGNPIDGKGPIKAAAYSRAQ
VKAPGILPRRSVHEPMQTGLKSVDALVPIGRGQRELIIGDRQTGKTAVALDAILNQKRWNNGSDEKKKL
YCVYVAVGQKRSTVAQLVQTLEQHDALKYSVIVAATASEAAPLQYIAPFTACAIGEWFRDNGRHALIVY
DDLSKQAVAYRQLSLLLRRPPGREAYPGDVFYLHSRLLERAAKMSDAYGGGSLTALPVIETQGGDVSAY
IPTNVISITDGQIFLEAELFYKGIRPAINVGLSVSRVGSAAQVKAMKQVAGSLKLFLAQYREVAAFAQF
GSDLDASTKQTLNRGERLTQLLKQKQYNPLAAEEQVPLIFAGVNGFLDNVALDRIGEFEEAFLGHLKSN
ETGILDAIKTKGELSKDELEKLRKVTEEFVASF
```

YEL032W_homolog 2637 bp public: 1..2637 (SEQ ID NO 719)
ATGGATGAACGATTTTTGAATCCACCACCTACAGCTGATCAAGATGATACTAATCAGCCACTTGATGCC
ATCTTTGGTGATAGAGTCAGAAGATTTCAAGAGTTTTTAGATAGAATTGATTCTAATACAGGTATAGAT
TACAGATCTATTATCAAAGATATGTTGATCAAGAGTAAGTTTAGATTGAGTGTTTCAATTGATGAAATA
AGAGAGTTTGACAGAGAATTTTGGTTGGGGTTGCTCAACCAGCCAGCTGACTATTTACCAGCTTGTGAA
AGAGCTTTGAGAGACACAGTTTTAGCTATTTACGACCCACAGGATCCAAGTTTCCCACATGACAGTTAT
GACCCTAACCAGCAATACTATTTATCATTCAAGGGAGCATTTGGGGGACATTCGCTCACTCCTAGATCG
ATTGATTCCAGCTATCTTTCCAAAATGGTTTCTATTGAAGGTATTGTGACTAGAGCTTCATTAGTTAGA
CCAAAGGTTATTAGATCGGTTCATTATGCTGAAAAAACTGGTAGATTTTATGCACGTGAATACCGAGAC
CAAACAACATCCTTTGATGCAATTGCTACTCCGGCTATATATCCAACTGAAGATATGGAAGGTAATAAA
TTAACCACAGAGTATGGTTATTCGACATACAGAGATTACCAGAAGATCTCTGTACAAGAAATGCCTGAA
ACAGCTCCTCCAGGTCAATTGCCAAGATCGGTTGACGTTATTTTGGATGATGATTTGGTGGATTTGACA
AAACCCGGTGATCGTGTACAAATTGTTGGTGTTTATCGTGCCTTAGGAGGTGCTGCAAACAATAGTTCT
TCTTTCAAAACGGTTATCTTAAGTAATTCTGTTTACTTGTTACATGCCAGATCAACAGGGGTTGCTTCA
CAAGAAAAGTTAACTGATCAAGATATTAGAAATATAAATAAACTTGCAAAGGATAGAAAGATTTTTGAT
ATTTTATCCCGTTCTTTGGCCCCTTCAATTTATGGGTTTGACTATATTAAGAAAGCTGTTTTACTTATG
ATGATGGGAGGTGTTGAAAAAAATTTAGATAATGGTACACATTTGAGAGGTGACATTAACATTTTGATG
GTGGGTGACCCATCCACTGCCAAATCTCAAGTATTACGGTTTGTGTTGAACACTGCTTCATTAGCTATT
GCCACTACTGGTAGAGGATCGTCAGGTGTAGGTTTAACAGCTGCTGTTACTACCGACAAGGAAACAGGA
GAAAGAAGATTGGAGGCTGGTGCAATGGTATTGGCTGACAGAGGTATTGTTTGTATTGATGAATTTGAT
AAAATGTCAGATATCGACCGAGTGGCCATTCACGAAGTTATGGAACAACAAACTGTCACTATTGCTAAA
GCTGGTATTCACACCTCATTGAATGCTCGTTGTTCTGTTATTGCTGCCGCAAATCCGGTTTTTGGACAG
TACGATGTCCATAAAGATCCACATAAAAATATTGCCTTGCCCGATTCATTATTGTCTCGTTTTGATTTG
CTCTTTGTTGTTACAGATGATGTCAACCCAACAAGAGACAGGGTTATTTCTGAGCATGTTTTAAGAATG
CACAGGTTTGTTCCTCCTGGATTGATGGAGGGAGAGCCAATCAGAGAAAAATCAGCAGTTACATTGGCT
GTCGGAGATGATGAAACCAATGAACAAGAATTATTAGAACAGCCAATGTTTGAAAAATTTAACACATTA
TTGCATGCTGGTATTCAAAACAAAAAGTCAAATAATATACTTTCGATTCCATTCTTGAAAAAATATGTC
CAGTACGCCAAGCAAAGAGTGCAACCAGTGTTGACCAAGGGTGCATCCGACTACATTGTTACTACATAT
TCCTCCTTAAGAAACGATTTGATAGGCAACAACCAAAGAAATACAGCTCCAATAACTGCTAGAACTTTA
GAAACTTTGATTCGTTTAGCAACAGCTCATGCAAAAGTCCGTTTATCCAAAACTGTTGATGTGAAAGAT
GCAAAAGTTGCCGAAGAGCTATTGAGATATGCATTATTCAAGGAAGTAGCCAAAAAGACAAAAAAGAGA
CAAAAAACTACAAGTATAGTGGACTCAGAAGAGGAGGAAGAGGATGAGTCTGATGCAGAAATGGAAAAT
TCCGATAACGAAATAATGCCCAGAGAAAGTACTAGAAGAACCAGAGCTACAGCACAAACACAGCCTCCA
CAACAGCAACAAGCATCTCCTTCACTAACACCCGAACCGCCACTTGGACATCGGGACGATGGAGATGAC
GATGGAGTTGGTGAAGAATTAGAACAATTCCATTTGTCATCATCTCAGCAACAACAGCAACAACAATAT
TTGCAACCATTGACTGAGAGATCATCAAGTAACATTGTATCATCTACCGCCACAAATGCAATCAGCGTT
GAGAGATTGAATATTTTCAAAAGAATACTAGCCCAGGTGTCACGTTCTGCATTATTTGCCAATGATCAA
GCTGCGGCAAACTATCATGACGTTACTCGTGCTATCAATGAACAGATGGAACAAGAAGATATTTTCTCA
GAGCAAGAGTTGAGTGCTGGATTTGAAGTGATGAGTTCTGAAAACAAGTTTTACCTAGAAAGTGATAAG
ATTTGGAAGATTTAA YEL032W_homolog 878 aa public: 1..878 (SEQ ID NO 720)
MDERFLNPPPTADQDDTNQPLDAIFGDRVRRFQEFLDRIDSNTGIDYRSIIKDMLIKSKFRLSVSIDEI
REFDREFWLGLLNQPADYLPACERALRDTVLAIYDPQDPSFPHDSYDPNQQYYLSFKGAFGGHSLTPRS
IDSSYLSKMVSIEGIVTRASLVRPKVIRSVHYAEKTGRFYAREYRDQTTSFDAIATPAIYPTEDMEGNK
LTTEYGYSTYRDYQKISVQEMPETAPPGQLPRSVDVILDDDLVDLTKPGDRVQIVGVYRALGGAANNSS
SFKTVILSNSVYLLHARSTGVASQEKLTDQDIRNINKLAKDRKIFDILSRSLAPSIYGFDYIKKAVLLM
MMGGVEKNLDNGTHLRGDINILMVGDPSTAKSQVLRFVLNTASLAIATTGRGSSGVGLTAAVTTDKETG
ERRLEAGAMVLADRGIVCIDEFDKMSDIDRVAIHEVMEQQTVTIAKAGIHTSLNARCSVIAAANPVFGQ
YDVHKDPHKNIALPDSLLSRFDLLFVVTDDVNPTRDRVISEHVLRMHRFVPPGLMEGEPIREKSAVTLA
VGDDETNEQELLEQPMFEKFNTLLHAGIQNKKSNNILSIPFLKKYVQYAKQRVQPVLTKGASDYIVTTY
SSLRNDLIGNNQRNTAPITARTLETLIRLATAHAKVRLSKTVDVKDAKVAEELLRYALFKEVAKKTKKR
QKTTSIVDSEEEEEDESDAEMENSDNEIMPRESTRRTRATAQTQPPQQQQASPSLTPEPPLGHRDDGDD
DGVGEELEQFHLSSSQQQQQQYLQPLTERSSSNIVSSTATNAISVERLNIFKRILAQVSRSALFANDQ
AAANYHDVTRAINEQMEQEDIFSEQELSAGFEVMSSENKFYLESDKIWKI YHR135C_homolog 1488 bp public: 1..1488 (SEQ ID NO 721)
ATGACAACAAACCCTGCTTTGGCGGCTGCTCAAGCATCTCATAATAATATTCCTACAAAGCAAATGAAT
CATTCAACTTCATCTTCAAACGGTAACGGTAGCAATAATTCATCCGTGGTTGGACTTCACTACAAGATT
GGGAAAAAAATTGGTCAAGGTTCTTTTGGTGTCATTTTTGAAGGTACTAATATAATAAATGGAGTACCC
GTGGCCATAAAATTTGAACCTAGAAAGACTGAAGCTCCTCAATTACGAGATGAATATAGAACTTATAAA
CATTTACAAGGATGTGACGGAATTCCTAATGCATATTATTTTGGTCAAGAAGGATTACATAATATTTTA
GTCATTGATTTATTGGGTCCTTCTTTAGAAGATTTATTTGATTGGTGTGGTAGAAGATTTAGTGTTAAA
ACCGTGGTACAAGTTGCTATACAAATGTTGACTTTAGTAGAAGAAGTTCATCGTCATGATTTAATCTAT
AGAGATATCAAACCCGACAATTTTTTAATTGGAAGAAGAGGTGCTACTGATGAAAATAATGTTCATTTG
ATTGATTTTGGTATGGCCAAGCAATATCGTGATCCAAGAACAAAGCAACATATTCCATATAGAGAGAAG
AAATCTTTGAGTGGGACAGCTAGATATATGAGTATTAACACTCATTTAGGAAGAGAACAATCAAGAAGA
GATGATTTAGAAGCATTGGGTCATGTATTTTTTTATTTCCTTAGAGGCCAATTACCTTGGCAAGGTTTA
AAAGCTCCCACCAATAAACAAAGTATGAGAAAATTGGTGATAAAAAGAGAACTACACCAGCAGTTACA
TTATGTGATGGCTTACCTCAACAATTTGCTGAATATTTAGATTCAGTTAGATCATTACCATTTGATGCT
GAACCTCCATATGAAGAATATAGAATGTTATTATTGTCAGTGTTGGATGATTTGGGTCAAGCTTGTGAT
GGAGATATGGATTGGATGCATCTTAATGGTGGTAGAGGTTGGGATGCTACAATTAATAAAAAACCCAAC
TTGCACGGTTATGGACATCCTAATCCACCAAATGAACGTGAAAGAAGACATCGTGATCAAAGAAGAACA
AGACAACATCAACAACTGCAACAAGTACAACAACAACAATTACAAGCTCAAGCTCAAGCACAACAATTA
CAACAATTACAACAAGCACAACAGGCACAACAACAACAACAACTGCAACAACATCAACCACTATCTGCA
GCCCAGTTACATCAACAAAAATTACAGCATTTGGTTAATCGACCATTACCACCAATTAAACAAGAATCA
CAATCAGCAATACAAAGTGGTAATGGACATCATGAACTTTTGAATAATAATTTAGGTGATCAGCATGGA
GGAAAACATGAAGGATACAGTTCACGACCAGATCAATATCAACAACAACAAATGGTTGCCGAAGAAGAA
GAAAACAAAGGGTTCTGGTCTAAATTGTGTTGTCATTAG YHR135C_homolog 495 aa public: 1..495 (SEQ ID NO 722)
MTTNPALAAAQASHNNIPTKQMNHSTSSSNGNGSNNSSVVGLHYKIGKKIGEGSFGVIFEGTNIINGVP
VAIKFEPRKTEAPQLRDEYRTYKHLQGCDGIPNAYYFGQEGLHNILVIDLLGPSLEDLFDWCGRRFSVK
TVVQVAIQMLTLVEEVHRHDLIYRDIKPDNFLIGRRGATDENNVHLIDFGMAKQYRDPRTKQHIPYREK
KSLSGTARYMSINTHLGREQSRRDDLEALGHVFFYFLRGQLPWQGLKAPTNKQKYEKIGDKKRTTPAVT
LCDGLPQQFAEYLDSVRSLPFDAEPPYEEYRMLLLSVLDDLGQACDGDMDWMHLNGGRGWDATINKKPN
LHGYGHPNPPNERERRHRDQRRTRQHQQSQQVQQQQLQAQAQAQQLQQLQQAQQAQQQQQSQQHQPLSA
AQLHQQKLQHLVNRPLPPIKQESQSAIQSGNGHHELLNNNLGDQHGGKHEGYSSRPDQYQQQQMVAEEE
ENKGFWSKLCCH YJL060W_homolog 1362 bp public: 1..1362 (SEQ ID NO 723)
ATGTTAAGACGGCTCTTTCCAATACGACAATTGTACACAACAACTAGAGCCATGGCCAGCAAATCAACA
GACCCAACTAGTTTGCATAATCCGTATTTTTATCAAAAACCGGGGCAAAAAGATATCTGGTCGTTAATC
AACGAAACTGCGGCCCAGGCACAACAAGAATCCGGCGAGCCAATTGTCAATTTGGGACAAGGGTTTTTC
TCCTACAATCCTCCTGAGTTTGCGATTAACGCTGTTGAGGAAGCATTGACCAAGCCGCAATTCAACCAA
TATGCACATGCTCGTGGAAACCCAAACTTATTGAAACAAGTGGCAGAGCACTATTCGCGATCGTATGGA
CGTGCTGTGGGGGTTGACGAGGTCCAAATCACCACGGGTGCAAATGAGGGAATGTTTGCCATTTTCTTT
GGTTTCTTGACCCCGGGCGATGAAGTCATTGTGTTTGAACCATTTTTTGACCAATACATCCCCAATGTT
GAAATGACAGGAGCCAAGATCAAGTACGTTGAAATCAAGTATCCCAAGAAATTTGACAACGAGGTTGTC
ACGGGCCAGGATTGGGAGATTGACTGGGAAGGATTGAATAATGCCATTACCGACAAGACCAAGATCATC
GTGATAAATACCCCACACAACCCAATCGGCAAAGTTTTCACCGAGAAGGAGTTGTACAAGATTGGCAAG
CTTGCCGTGGAACACAATTTAATCCTTGTCAGCGACGAGGTTTACGAGAACTTGTATTATACTGACAAG
TTCCCTCGTCCAGCTGCATTACCACAGTTGCCTGAATTGGCTGAAAGGACGTTGACAGTGGGTTCTGCT
GGGAAATCATTTGCTGCCACTGGTTGGAGAGTAGGGTATATCCAGGGCCCTGCCAATTTGATTAAATTT
GTAACAGCGGCCCACACCAGAATTTGTTTCTCGACCCCAGCACCATTGCAACAGGCAGTATCTCAGGGG
TTTGAGCAGGCTGAGAAATCAAACTATTTTGAGAACACTCGAAAGGAGTATGAACACAAATACAAAATA
TTCACCAAGGTATTTGACGACTTGGGGTTACCCTACACCGTTGCCGAAGGAGGGTACTTTGTGTTGGTG
AACTTGCTGAAAGTTAAGATACCCGCAGATTATGAGTTTCCCGGAACCATCAGCGATAGAGGCACTTTA
GATTTCAAATTGGCGTATTGGTTGATCAAAGAAATTGGGGTTGTGGGAATCCCTCCAACAGAGTTTTTA
ACCGAATCGAATAGAAAGGGGAACGGCTTAGAAAATTGTGTCAGATTTGCTGTTTGCAAAGATGATTCT
GTTTTAGAAGACGCGGTTGAGAGATTGAAAAAATTAAAAGACTATTTATAA YJL060W_homolog 453 aa public: 1..453 (SEQ ID NO 724)
MLRRLFPIRQLYTTTRAMASKSTDPTSLHNPYFYQKPGQKDIWSLINETAAQAQQESGEPIVNLGQGFF
SYNPPEFAINAVEEALTKPQFNQYAHARGNPNLLKQVAEHYSRSYGRAVGVDEVQITTGANEGMFAIPF
GFLTPGDEVIVFEPFFDQYIPNVEMTGAKIKYVEIKYPKKFDNEVVTGQDWEIDWEGLNNAITDKTKII
VINTPHNPIGKVFTEKELYKIGKLAVEHNLILVSDEVYENLYYTDKFPRPAALPQLPELAERTLTVGSA
GKSFAATGWRVGYIQGPANLIKFVTAAHTRICFSTPAPLQQAVSQGFEQAEKSNYFENTRKEYEHKYKI
FTKVFDDLGLPYTVAEGGYFVLVNLSKVKIPADYEFPGTISDRGTLDFKLAYWLIKEIGVVGIPPTEFL
TESNRKGNGLENCVRFAVCKDDSVLEDAVERLKKLKDYL YML028W_homolog 591 bp public: 1..591 (SEQ ID NO 725)
ATGGCTCCAGTCGTTCAACAACCAGCTCCAAGTTTCAAGAAAACCGCCGTCGTTGATGGTGTCTTTGAA
GAAGTCACTTTAGAACAATACAAAGGTAAATGGGTCTTGTTGGCCTTTATTCCATTGGCCTTCACATTC
GTCTGCCCATCAGAAATTATTGCTTATTCCGAAGCTGTAAAGAAATTTGCCGAAAAGGATGCTCAAGTT
TTGTTTGCCTCTACTGACTCCGAATACACCTGGTTGGCTTGGACCAATGTCGCCAGAAAAGACGGTGGT
ATTGGCAAAGTCGACTTCCCAGTCTTGGCTGACACCAACCACTCCTTGTCCAGAGACTACGGTGTCTTA
ATTGAAGAAGAAGGTGTTGCCTTGAGAGGTATTTTCTTGATTGATCCAAAGGGTGTCTTGAGACAAATC
ACCATCAATGACTTGCCAGTCGGTAGATCTGTTGAAGAATCCTTGAGATTGTTGGAGGCTTTCCAATTC
ACTGAAAAATACGGTGAAGTTTGTCCAGCTAACTGGCACCCAGGTGATGAAACCATCAAGCCAAGCCCA
GAAGCATCCAAGGAATACTTCAACAAAGTCAACAAATAA YML028W_homolog 196 aa public: 1..196 (SEQ ID NO 726)
MAPVVQQPAPSFKKTAVVDGVFEEVTLEQYKGKWVLLAFIPLAFTFVCPSEIIAYSEAVKKFAEKDAQV
LFASTDSEYTWLAWTNVARKDGGIGKVDFPVLADTNHSLSRDYGVLIEEEGVALRGIFLIDPKGVLRQI
TINDLPVGRSVEESLRLLEAFQFTEKYGEVCPANWHPGDETIKPSPEASKEYFNKVNK YOL100W_homolog 2835 bp public: 1..2835 (SEQ ID NO 727)
ATGCATAAATTTAGATATTCTTTGCACCAACACTATAGCAAACGCAATTCAAGTGACAAATCCAAAGAC
AGTCCAATTAGCCAAAACAGCAATGAAGAAAATGATTCGACTAAATTAAGTTCAAGTAGTCTTCAAGAC
TTACATGATGATCTCGATGATATTTATAACAACTATACTTTAGCACAGGGTACCAATAACAACAGTGTA
GATACATTGGATTCTGAAAATAATCAAGCTATAAATAAGTTTATTGATAAACCTCCAGCAATTCATGGT
ATGGAACCACAACTACCGGTGATGCACGTTTCTTCACGATTATCTTCCTTAGGTAATACCACCAATGAA
ACCGGTGAAAGCATCGCCAAAAGTGCACCAGGAACTCCGTTATCTTCACATTCATTTGATTTCAGACCG
CATCATCCTCGTGCAGTAACAAACTCATCCCTCAATGTATTGTTAGACACCCCTAATGTCAGTTCCGAA
TTCAATCATTTAGTGGATCAAACACCACCCAATGAGTCGGTAGAAAGGTTTGACGACAGTAATAATACT
GTGGACAATACAGAAGAGGAAGAAAATAATGATGATACAGACGAAATACCAAAATCCGAAACATTGAAA
CAAAACGAGGAGAATTGGGAAAAAAGGGTGCTGCAGTTAAAACTATCAAGACTATGGATGGAGAAATG
AAAACTATTCGGCGAAATGTTACTGATTTCAAATTTGGTAAAGAATTGGGTGAAGGTTCATATTCCACG
GTGATTTTAGCCACTGATAAGATTACTGGTAAACAATATGCTGTAAAAGTACTTGATAAGCGACATATT
ATAAAAGAAAAGAAAGTCAAGTATGTCAATATAGAAAAACATGCATTGAATCGATTAAGTAATAGATTA
GGGGTTATTTCATTATATTTCACCTTCCAGGATAAAGATTCGCTTTATTTTGTTTTGGATTATGCTTCA
AATGGTGAATTATTGACATTGATCAAGAGATACAATACTTTAAATGAGGAATGTACTAGACATTTTGGT
GCACAAATATTAGATGCTATTAAATATATGCATGATAATGGTGTTATACATCGAGACCTAAAACCAGAG
AATATATTATTAGATGACAAAATGAGAATTCAAATTACAGATTTTGGTACTGCAAGATTATTAGAGAAA
AAGAATGATGAAAGTGAAGAATACCCAGTGGATGTAAGAGCAAAATCATTTGTTGGAACCGCTGAATAT
GTATCCCCTGAATTATTAGAAAATAAGTATTGTGGTAAACCTGGAGATGTTTGGGCTTTTGGTTGCATC
ATATATCAAATGATTGCTGGGAAACCACCATTTAAGGCAACTAATGAATATTTAACGTTTCAAAAAATT
ACGAAATTGCAATTTGCGTTTAGTGCAGGATTCCCTACAATTATTAGAGATTTAATAAAGAAGATTCTT
GTGTTGCAACCTTCACGACGTGCCACCATTCCAGAAATACAAAAACATTACTTTTTCCAATCGGTCGAC
TTTAAAGATTTTGATCTGATTTGGTTGTCTGATCCTCCTGAAATAGGACCTTATAAAATGACAGCAAAA
TCCATGATGAAAGTACCGGAATTGAATAAGGCACCTATAACCACAGTCATTAAGAAGAATGTGAAGAAA
TCCACAAACTCAAATTCAAATACCAACAATGTCGCCACTGCTGTTGGTGGTAGTAGTAGTAACGGACAT
AAAGGGTCATCACCGACTCCTGAGAAAGAGCCGAGCCCAGCTACTATTAATAACAAGTCCACAGAAAAA
GTTAGTGCCGCTAGTGTAGCTGCATATGTTTTAAACAAACCAGCTACAAACCAAAATTCCAGTACATCC
GAGGATTCATCTAAGCGTAGCAGCAACTCCAATGAAACTCGCAAACTTTCATATTCACAACAGGATTAT
ATTCCGGGAACAAATATTTTACGTCCACAGATTAGTACTAGACCGTCAGTAGGATCTTATGTGAAAACC
ACACCATCAAAGGATAGAAAAACATTAACCAAGGTCCCACTGAATATCCATCAACAACAAGAAAAAGTG

```
AAACCGAAAGTAATGGAAGTGAAGCCAGCAACTACATTGGAAGCAGCATGGGAACCATATTTAACCCAT
CCAGATGAAAGAATACTTCGTATTGGTCCAGTTATTGCTCATAAAGAACCAACAGAACCATTTGAAAAG
AAGAATAAAGCATCTTTACATATATCACCTTTGGATATAAATAAAGAACAAAGAAGTAGATCCAATACT
AGTTTACTTACACAAATTGTAAATGAAGTAAACAATAACACCAGCGAATTGAAAAAAGTGGAAAATGCT
GATGAATCACTTGCCATTATTGAACCACAATATAATATGAAGAGAAGTCCAACTTCTGATAGTAAGAAA
AGTATGGATATTGAAAGATCTGCATCTACTTCTGGAAGTAGAATTAGTAAGAAGGCAATTTTCAAAAAA
TTGGGGTTTAGTCATTTAGAAAAAAATGATAGTGAAGAATCAAATGGTCCTAGTTTAACGGAAAAACCA
CAAACTTGTACATTGGTTGTTACAACTCATGGTCGAGCATTACTTTTCATTAGAAATGATATAGAATCC
AATTATCTTTTAATTGCTGAAATCAAATTGAAATATCCATTTATTCATTTCCAAGAATTAGTTATATCA
CAAACTAAATTTTCTAAATTAGTACCATCAGTCGGAGTATTTGTCATTAGTTCAATTGATAATTCATTA
ATTTTTGAAGTAGAAAAATTTGAAGTGAATCAATGGACTGAAGCATTAGCTAAATCTAAATATAATGAA
ATATAA
```

YOL100W_homolog 944 aa public: 1..944 (SEQ ID NO 728)
MHKFRYSLHQHYSKRNSSDKSKDSPISQNSNEENDSTKLSSSSLQDLHDDLDDIYNNYTLAQGTNNNSV
DTLDSENNQAINKFIDKPPAIHGMEPQLPVMHVSSRLSSLGNTTNETGESIAKSAPGTPLSSHSFDFRP
HHPRAVTNSSLNVLLDTPNVSSEFNHLVDQTPPNESVERFDDSNNTVDNTEEEENNDDTDEIPKSETLK
QNEENWEKKGAAVKTIKTMDGEMKTIRRNVTDFKFGKELGEGSYSTVILATDKITGKQYAVKVLDKRHI
IKEKKVKYVNIEKHALNRLSNRLGVISLYFTFQDKDSLYFVLDYASNGELLTLIKRYNTLNEECTRHFG
AQILDAIKYMHDNGVIHRDLKPENILLDDKMRIQITDFGTARLLEKKNDESEEYPVDVRAKSFVGTAEY
VSPELLENKYCGKPGDVWAFGCIIYQMIAGKPPFKATNEYLTFQKITKLQFAFSAGFPTIIRDLIKKIL
VLQPSRRATIPEIQKHYFFQSVDFKDFDSIWLSDPPEIGPYKMTAKSMMKVPELNKAPITTVIKKNVKK
STNSNSNTNNVATAVGGSSSNGHKGSSPTPEKEPSPATINNKSTEKVSAASVAAYVLNKPATNQNSSTS
EDSSKRSSNSNETRKLSYSQQDYIPGTNILRPQISTRPSVGSYVKTTPSKDRKTLTKVPSNIHQQQEKV
KPKVMEVKPATTLEAAWEPYLTHPDERILRIGPVIAHKEPTEPFEKKNKASLHISPLDINKEQRSRSNT
SLLTQIVNEVNNNTSELKKVENADESLAIIEPQYNMKRSPTSDSKKSMDIERSASTSGSRISKKAIFKK
LGFSHLEKNDSEESNGPSLTEKPQTCTLVVTTHGRALLFIRNDIESNYLLIAEIKLKYPFIHFQELVIS
QTKFSKLVPSVGVFVISSIDNSLIFEVEKFEVNQWTEALAKSKYNEI YJL166W_homolog 288bp PathoSeq: 1..288 (SEQ ID NO 729)
```
ATGGCAGGTGCACCACATCCACATACTTATATGGGCTGGTGGGGTAGTTTAGGCTCCCCAAAGCAAAAA
TATATTACTCAATATACTATTTCTCCATATGCTGCTAAACCATTAAAGGGGGCTGCTTATAATGCTGTT
TTCAATACTTTTAGAAGAACCAAGAATCAATTTCTTTATGTTGCCATTCCATTTGTTGTTGTTTGGAGT
ATTTGGACTAGAGCTAGAGATTATAATGAATACTTGTACACTAAAGAAGGTAGAGAAGAATTGGAAAGA
GTTAATGTTTAA
```

YJL166W_homolog 95aa PathoSeq: 1..95 (SEQ ID NO 730)
MAGAPHPHTYMGWWGSLGSPKQKYITQYTISPYAAKPLKGAAYNAVFNTFRRTKNQFLYVAIPFVVVWS
IWTRARDYNEYLYTKEGREELERVNV YLR038C_homolog 252bp PathoSeq: 1..252 (SEQ ID NO 731)
```
ATGCCAGTCGATCCAGCTACTTTTAAATTCGAAACTCCACAATTTGACCCAAGATTCCCAAACCAAAAC
CAATCCAAACATTGTGCTCAAGCCTACGTTGATTACCACAAATGTGTCAATGTGAAAGGTGAAGAATTT
GAACCATGCAAAATCTTTTTCAAAACTTTCACTTCATTATGTCCTTTGGATTGGGTCGAAAAATGGGAT
GATCAAAGAGCTGCTGGTAAATTCCCAGTCAACATGGACGCTTAG
```

YLR038C_homolog 83aa PathoSeq: 1..83 (SEQ ID NO 732)
MPVDPATFKFETPQFDPRFPNQNQSKHCAQAYVDYHKCVNVKGEEFEPCKIFFKTFTSLCPLDWVEKWD
DQRAAGKFPVNMDA

Human homologues

>YGL080W_homolog, CDS: 1-330 bp(SEQ ID NO 675)
ATGGCGGGCGCGTTGGTGCGGAAAGCGGCGGACTATGTCCGAAGCAAGGATTTCCGGGACTACCTCATG
AGTACGCACTTCTGGGGCCCAGTAGCCAACTGGGGTCTTCCCATTGCTGCCATCAATGATATGAAAAAG
TCTCCAGAGATTATCAGTGGGCGGATGACATTTGCCCTCTGTTGCTATTCTTTGACATTCATGAGATTT
GCCTACAAGGTACAGCCTCGGAACTGGCTTCTGTTTGCATGCCACGCAACAAATGAAGTAGCCCAGCTC
ATCCAGGGAGGGCGGCTTATCAAACACGAGATGACTAAAACGGCATCTGCATAA >YGL080W_homolog, 109 aa(SEQ ID NO 676)
MAGALVRKAADYVRSKDFRDYLMSTHFWGPVANWGLPIAAINDMKKSPEIISGRMTFALCCYSLTFMRF
AYKVQPRNWLLFACHATNEVAQLIQGGRLIKHEMTKTASA >YGR243W_homolog, CDS: 1-384 bp(SEQ ID NO 677)
ATGTCGGCCGCCGGTGCCCGAGGCCTGCGGGCCACCTACCACCGGCTCCTCGATAAAGTGGAGCTGATG
CTGCCCGAGAAATTGAGGCCGTTGTACAACCATCCAGCAGGTCCCAGAACAGTTTTCTTCTGGGCTCCA
ATTATGAAATGGGGGTTGGTGTGTGCTGGATTGGCTGATATGGCCAGACCTGCAGAAAAACTTAGCACA
GCTCAATCTGCTGTTTTGATGGCTACAGGGTTTATTTGGTCAAGATACTCACTTGTAATTATTCCAAAA
AATTGGAGTCTGTTTGCTGTTAATTTCTTTGTGGGGGCAGCAGGAGCCTCTCAGCTTTTTCGTATTTGG
AGATATAACCAAGAACTAAAAGCTAAAGCACACAAATAA >YGR243W_homolog, 127 aa(SEQ ID NO 678)
MSAAGARGLRATYHRLLDKVELMLPEKLRPLYNHPAGPRTVFFWAPIMKWGLVCAGLADMARPAEKLST
AQSAVLMATGFIWSRYSLVIIPKNWSLFAVNFFVGAAGASQLFRIWRYNQELKAKAHK >YGR183C_homolog, CDS: 1-399 bp(SEQ ID NO 679)
ATGGCGGCCGCGACGTTGACTTCGAAATTGTACTCCCTGCTGTTCCGCAGACCTCCACCTTCGCCCTCA
CCATCATCC~~GGGCGTCATGTTCTTCGAGCGCGCCTTC~~ATCAAGGCGCGGACGCTATCTACGACCACA
TCAACGAGG~~~AAGCTGTGGAAACACATCAAGCACAAG~ATGAGAACAAGTAGTTCCTTGGAGGCCCCC
ATCCAGGCCAGAAGGACCAGGTCCACCCAGCAGCTGTTTGCCCAGAGCTGGAGCCTCAGCTTGAAGATG
ATGCTCAAGGTACTCTTCATGGACCACCATTCGCTGTTGGCAAGAAACGGCTTTACTTACAAAACAGAC
TCTTTACCTTCTGCTGTGTTTGAAGTATGTTTAGTCAGCATGCTCAGGAAATAA >YGR183C_homolog, 132 aa(SEQ ID NO 680)
MAAATLTSKLYSLLFRRPPPSPSPSSWASCSSSAPSIKARTLSTTTSTRGSCGNTSSTSMRTSSSLEAP
IQARRTRSTQQLFAQSWSLSLKMMLKVLFMDHHSLLARNGFTYKTDSLPSAVFEVCLVSMLRK >YBR009C_homolog, CDS:1-312 bp(SEQ ID NO 681)
ATGTCTGGCCGCGGCAAAGGCGGGAAGGGTCTTGGCAAAGGCGGCGCTAAGCGCCACCGTAAAGTACTG
CGCGACAATATCCAGGGCATCACCAAGCCGGCCATCCGGCGCCTTGCTCGCCGCGGCGGCGTGAAGCGC
ATCTCCGGCCTCATCTACGAGGAGACTCGCGGGGTGCTGAAGGTGTTCCTGGAGAACGTGATCCGGGAC
GCCGTGACCTATACAGAGCACGCCAAGCGCAAGACGGTCACCGCCATGGATGTGGTCTACGCGCTCAAG
CGCCAGGGCCGCACCCTCTACGGTTTCGGTGGTTGA >YBR009C_homolog, 103 aa(SEQ ID NO 682)
MSGRGKGGKGLGKGGAKRHRKVLRDNIQGITKPAIRRLARRGGVKRISGLIYEETRGVLKVFLENVIRD
AVTYTEHAKRKTVTAMDVVYALKRQGRTLYGFGG >YGR209C_homolog, CDS: 1-318 bp(SEQ ID NO 683)
ATGGTGAAGCAGATCGAGAGCAAGACTGCTTTTCAGGAAGCCTTGGACGCTGCAGGTGATAAACTTGTA
GTAGTTGACTTCTCAGCCACGTGGTGTGGGCCTTGCAAAATGATCAACCCTTTCTTTCATTCCCTCTCT
GAAAAGTATTCCAACGTGATATTCCTTGAAGTAGATGTGGATGACTGTCAGGATGTTGCTTCAGAGTGT
GAAGTCAAATGCACGCCAACATTCCAGTTTTTTAAGAAGGGACAAAAGGTGGGTGAATTTTCTGGAGCC
AATAAGGAAAAGCTTGAAGCCACCATTAATGAATTAGTCTAA >YGR209C_homolog, 105 aa(SEQ ID NO 684)
MVKQIESKTAFQEALDAAGDKLVVVDFSATWCGPCKMINPFFHSLSEKYSNVIFLEVDVDDCQDVASEC
EVKCTPTFQFFKKGQKVGEFSGANKEKLEATINELV >YPR028W_homolog, CDS: 1-594 bp(SEQ ID NO 685)
CCGAGCGGCGAGACGGTCCCCGCCATGTCTGCGGCCATGAGGGAGAGGTTCGACCGGTTCCTGCACGAG
AAGAACTGCATGACTGACCTTCTGGCCAAGCTCGAGGCCAAAACCGGCGTGAACAGGAGCTTCATCGCT
CTTGGTGTCATCGGACTGGTGGCCTTGTACCTGGTGTTCGGTTATGGAGCCTCTCTCCTCTGCAACCTG
ATAGGATTTGGCTACCCAGCCTACATCTCAATTAAAGCTATAGAGAGTCCCAACAAAGAAGATGATACC
CAGTGGCTGACCTACTGGGTAGTGTATGGTGTGTTCAGCATTGCTGAATTCTTCTCTGATATCTTCCTG
TCATGGTTCCCCTTCTACTACATACTGAAGTGTGGCTTCCTGTTGTGGTGCATGGCCCCGAGCCCTTCT
AATGGGGCTGAACTGCTCTACAAGCGCATCATCCGTCCTTTCTTCCTGAAGCACGAGTCCCAGATGGAC
AGTGTGGTCAAGGACCTTAAAGACAAGGCCAAAGAGACTGCAGATGCCATCACTAAAGAAGCGAAGAAA
GCTACCGTGAATTTACTGGGTGAAGAAAAGAAGAGCACCTAA >YPR028W_homolog, 197 aa(SEQ ID NO 686)
PSGETVPAMSAAMRERFDRFLHEKNCMTDLLAKLEAKTGVNRSFIALGVIGLVALYLVFGYGASLLCNL
IGFGYPAYISIKAIESPNKEDDTQWLTYWVVYGVFSIAEFFSDIFLSWFPFYYILKCGFLLWCMAPSPS
NGAELLYKRIIRPFFLKHESQMDSVVKDLKDKAKETADAITKEAKKATVNLLGEEKKST

```
      Met Asp Gly Ser Gly Glu Gln Leu Gly Ser Gly Gly Pro Thr Ser Ser Glu Gln Ile Met
  1   ATG GAT GGT TCT GGT GAA CAA TTG GGT TCT GGT GGT CCA ACC TCT TCT GAA CAA ATC ATG

Lys Thr Gly Ala Phe Leu Leu Gln Gly Phe Ile Gln Asp Arg Ala Gly Arg Met Ala Gly
 61   AAA ACC GGT GCT TTC TTG TTG CAA GGT TTC ATC CAA GAT AGA GCT GGT AGA ATG GCT GGT

Glu Thr Pro Glu Leu Thr Leu Glu Gln Pro Pro Gln Asp Ala Ser Thr Lys Lys Leu Ser
121   GAA ACC CCA GAA TTG ACC TTG GAA CAA CCA CCA CAA GAT GCT TCT ACC AAA AAA TTG TCT

Glu Cys Leu Arg Arg Ile Gly Asp Glu Leu Asp Ser Asn Met Glu Leu Gln Arg Met Ile
181   GAA TGT TTG AGA AGA ATC GGT GAT GAA TTG GAT TCT AAC ATG GAA TTG CAA AGA ATG ATC

Ala Asp Val Asp Thr Asp Ser Pro Arg Glu Val Phe Phe Arg Val Ala Ala Asp Met Phe
241   GCT GAT GTC GAT ACC GAT TCT CCA AGA GAA GTC TTC TTC AGA GTC GCT GCT GAT ATG TTC

Ala Asp Gly Asn Phe Asn Trp Gly Arg Val Val Ala Leu Phe Tyr Phe Ala Ser Lys Leu
301   GCT GAT GGT AAC TTC AAC TGG GGT AGA GTC GTC GCT TTG TTC TAC TTC GCT TCT AAA TTG

Val Leu Lys Ala Leu Cys Thr Lys Val Pro Glu Leu Ile Arg Thr Ile Met Gly Trp Thr
361   GTC TTG AAA GCT TTG TGT ACC AAA GTC CCA GAA TTG ATC AGA ACC ATC ATG GGT TGG ACC

Leu Asp Phe Leu Arg Glu Arg Leu Leu Val Trp Ile Gln Asp Gln Gly Gly Trp Glu Gly
421   TTG GAT TTC TTG AGA GAA AGA TTG TTG GTC TGG ATC CAA GAT CAA GGT GGT TGG GAA GGT

Leu Leu Ser Tyr Phe Gly Thr Pro Thr Trp Gln Thr Val Thr Ile Phe Val Ala Gly Val
481   TTG TTG TCT TAC TTC GGT ACC CCA ACC TGG CAA ACC GTC ACC ATC TTC GTC GCT GGT GTC

Leu Thr Ala Ser Leu Thr Ile Trp Lys Lys Met Gly (SEQ ID NO 2)
541   TTG ACC GCT TCT TTG ACC ATC TGG AAA AAA ATG GGT TAA (SEQ ID NO 1)
```

Fig. 6

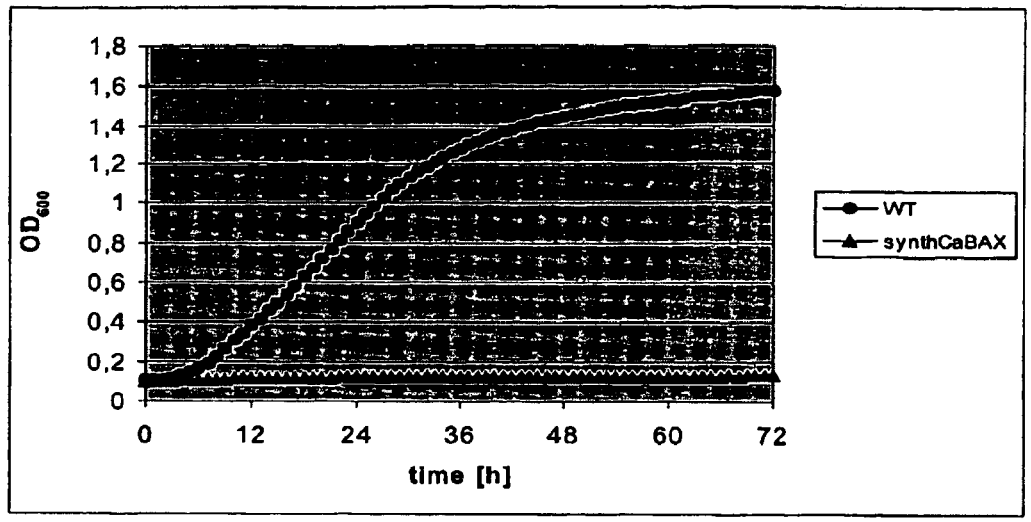
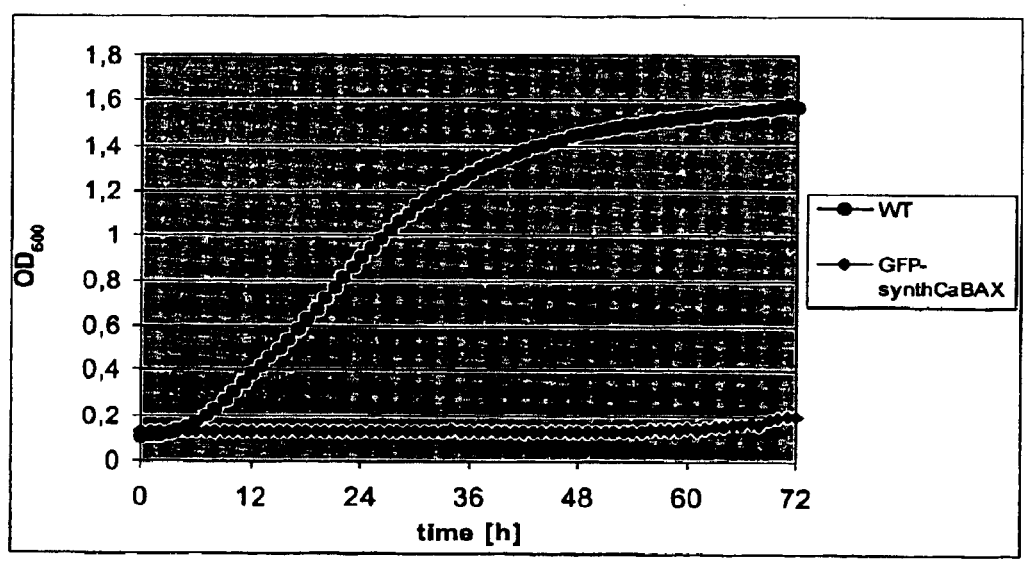
Fig. 9.

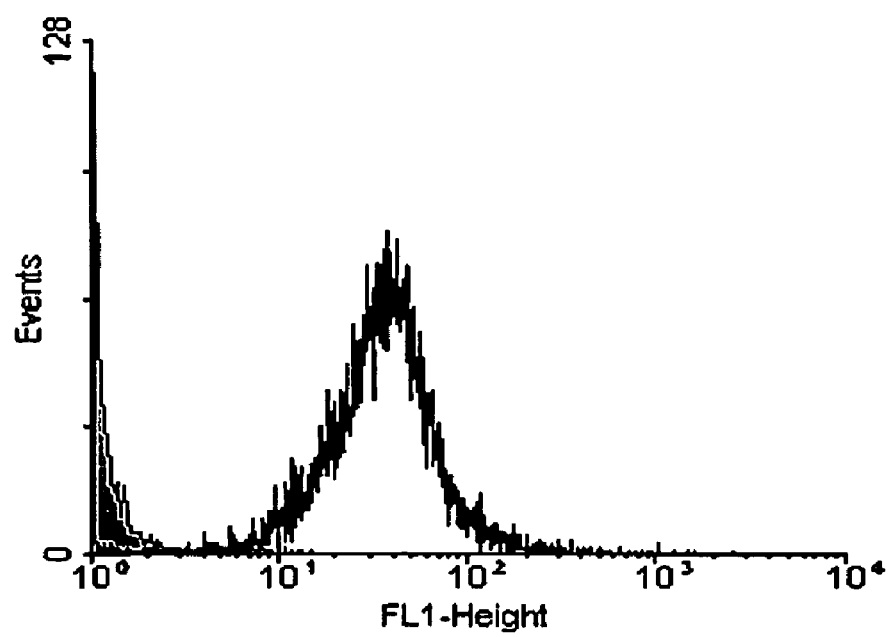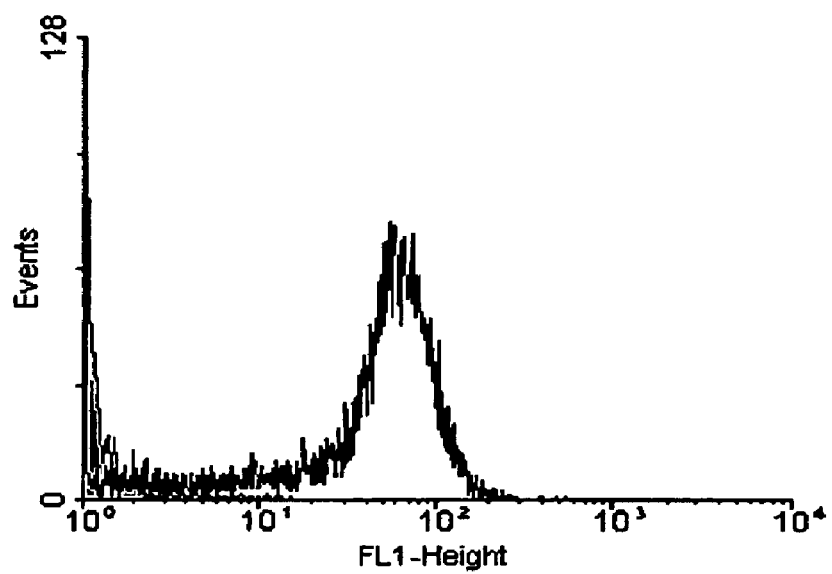
Fig.12.

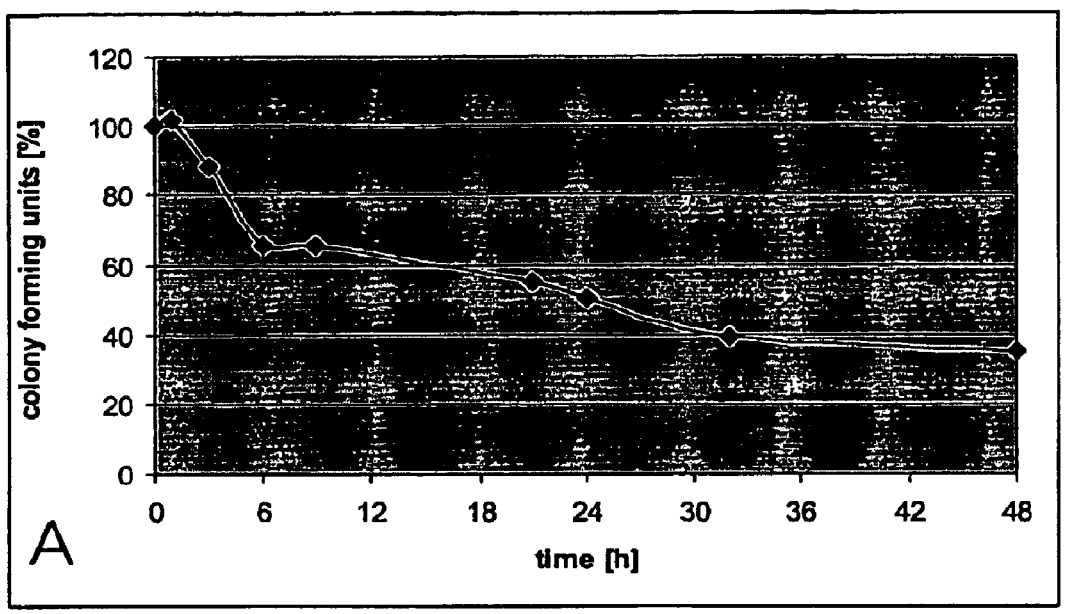
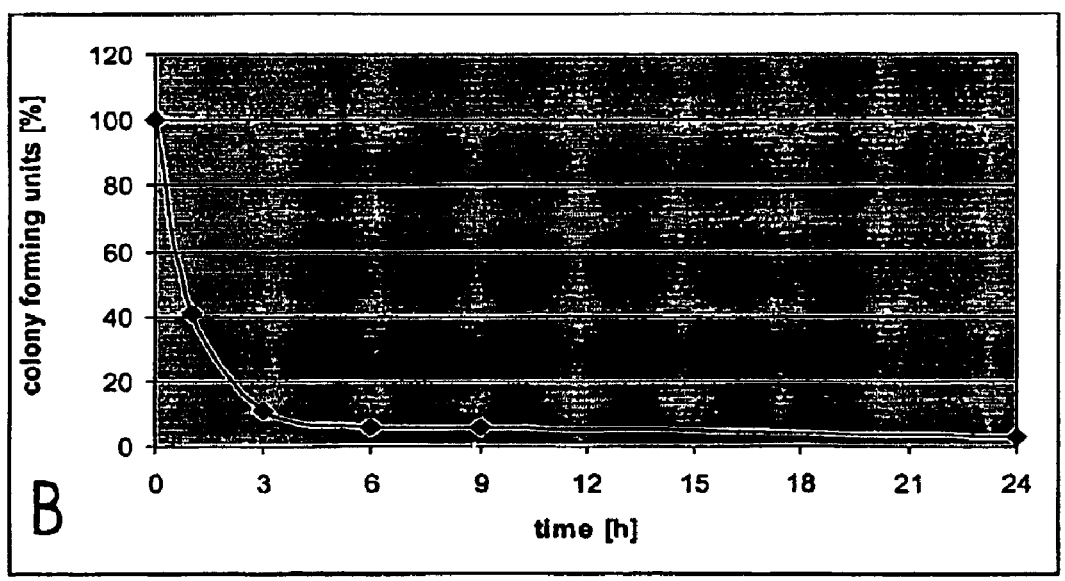
Fig. 13.

BAX-RESPONSIVE GENES FOR DRUG TARGET IDENTIFICATION IN YEAST AND FUNGI

SEQUENCE LISTING

The instant application contains a "lengthy" Sequence Listing which has been submitted via triplicate CD-R in lieu of a printed paper copy, and is hereby incorporated by reference in its entirety. Said CD-R, recorded on Jan. 6, 2004, are labeled "CRF", "Copy 1" and "Copy 2", respectively, and each contains only one identical 1.79Mb file (JAB1667.APP).

FIELD OF THE INVENTION

The present invention relates to the identification of genes and proteins encoded thereof from yeast and fungi whose expression is modulated upon programmed cell death and which genes, proteins or functional fragments and equivalents thereof may be used as selective targets for drugs to treat infections caused by or associated with yeast and fungi or for the treatment of proliferative disorders or for the prevention of apoptosis in certain diseases.

BACKGROUND TO THE INVENTION

Invasive fungal infections (e.g. *Candida* spp., *Aspergillus* spp., *Fusarium* spp., *Zygomycetes* spp.) (Walsh, 1992) have emerged during the past two decades as important pathogens causing formidable morbidity and mortality in an increasingly diverse and progressively expanding population of immunocompromised patients. Those with the acquired immune deficiency syndrome (AIDS) constitute the most rapidly growing group of patients at risk for life-threatening mycosis. But fungal Infections have also increased in frequency in several populations of other susceptible hosts, including very-low-birth-weight infants, cancer patients receiving chemotherapy, organ transplant recipients, burn patients and surgical patients with complications.

These fungal infections are not limited to humans and other mammals, but are also important in plants where they can cause diseases or cause the production of unwanted compounds (e.g. *Fusarium* spp., *Aspergillus* spp., *Botritis* spp., *Cladosporium* spp.).

Although recent advances in antifungal chemotherapy have had an impact on these mycoses, expanding populations of immunocompromised patients will require newer approaches to antifungal therapy. The discovery of novel antifungal agents is thus an essential element of any new antifungal therapy.

Classical approaches for identifying antifungal compounds have relied almost exclusively on inhibition of fungal or yeast growth as an endpoint. Libraries of natural products, semi-synthetic, or synthetic chemicals are screened for their ability to kill or arrest growth of the target pathogen or a related nonpathogenic model organism. These tests are cumbersome and provide no information about a compound's mechanism of action. The promising lead compounds that emerge from such screens must then be tested for possible host-toxicity and detailed mechanism of action studies must subsequently be conducted to identify the affected molecular target.

Cells from multicellular organisms can commit suicide in response to specific signals or injury by an intrinsic program of cell death. Apoptosis is a form of programmed cell death which leads to elimination of unnecessary or damaged cells. Cells that are either unwanted or potentially harmful to the organism undergo the apoptotic process and show events like cell shrinkage, chromatin condensation, cytoplasmic condensation, digestion of nuclear DNA, loss of mitochondrial membrane potential, plasma membrane blebbing and phagocytosis of the cell debris (Schwartz, et al. 1993). The Bcl-2 family of proteins is centrally involved in the control of the programmed cell death process (PCD). Proteins of this group belong either to the inhibitors of cell death (Bcl-2, Bcl-$X_L$) or to the group of proteins promoting apoptosis (Bax, Bak) (Oltvai and Korsmeyer 1994; Knudson and Korsmeyer 1997; Reed et al. 1998). The ability of the Bcl-2 family of proteins to regulate life and death of a cell is conserved across evolution. Finding of homologues of PCD regulatory genes in plants and animals suggests the possibility that some functions involved in this process may originally have evolved in unicellular organisms, before a divergent development between the plant and the animal kingdom had happened (Apte et al. 1995).

Expression of the pro-apoptotic human or mouse Bax protein in *Saccharomyces cerevisiae* did induce cell death in this budding yeast (Sato et al. 1994; Greenhalf et al. 1996; Zha et al. 1996). It was initially described as a process that resembled autophagy with dissolution of the internal organelles and vacuolisation. The apoptotic features characteristic for multicellular eucaryotic cells like morphological changes In nuclear shape and chromatin condensation, were not observed in this yeast (Zha et al. 1996). It was therefore suggested that Bax-induced cell death in *S. cerevisiae* is due to the toxicity of the Bax protein itself, mediated by a hypothetical pore-formation without any involvement of a death program (Muchmore et al. 1996).

Bax expression in the fission yeast *Schizosaccharomyces pombe* did in contrast show some of the typical apoptotic changes like DNA fragmentation, chromatin condensation, dissolution of the nuclear envelope and cytosolic vacuolisation, suggesting the presence of the evolutionary conserved PCD pathway in this unicellular eucaryote (Ink et al. 1997; Jurgensmeier et al. 1997). Since it is very unlikely that species dependent differences in the toxicity of the Bax protein are the reason for this observed difference between the two yeasts, a bona fide cell death pathway may well be present in *S. cerevisiae*.

Recent findings of a yeast mutant in the cell division cycle gene CDC48 show a number of morphological and molecular features that are considered typical indicators of apoptosis markers in metazoan cells: exposure of phosphatidylserine on the outer leaflet of the cytoplasmic membrane, DNA breakage as well as chromatin condensation and fragmentation, supporting the existence of a basic PCD machinery in this unicellular yeast. This theory was supported by the analysis of a wild type yeast cell expressing the human Bax protein. Comprehensive tests for morphological markers of apoptosis did show a series of changes, identical to morphological markers defining apoptosis (Ligr, Madeo et al. 1998). Recent findings from the same group (Madeo et al., 1999) implicate oxygen stress as a general regulator of apoptosis in yeast but the actual mechanism of Bax lethality in *S. cerevisiae* remains unclear. It is an aim of the present invention to provide new bax sequences for expression in yeast and fungi and tools for identifying yeast and candida functions in the pathways leading to programmed cell death.

It is an aim of the present invention to provide nucleic acids as well as polypeptides which represent potential molecular targets for the identification of new compounds which can be used in alleviating diseases or conditions associated with yeast or fungal infections.

It is a further aim of the present invention to provide uses of these nucleic acid and polypeptide molecules for treating diseases associated with yeast or fungi or for the preparation of (a) medicament(s) for treating said diseases.

It is also an aim of the invention to provide pharmaceutical compositions and vaccines comprising these nucleic acids or polypeptides.

It is also an aim of the present invention to provide vectors comprising these nucleic acids, as well as host cells transfected or transformed with said vectors.

It is also an aim of the invention to provide antibodies against these polypeptides, which can be used as such, or in a composition as a medicament for treating diseases associated with yeast and fungi.

It is another aim of the invention to provide methods to selectively identify compounds or polypeptides capable of inhibiting or activating expression of the polypeptides of the invention or capable of selectively modulating expression or functionality of such polypeptides. The nucleic acid and polypeptide molecules alternatively can be incorporated into an assay or kit to identify these compounds or polypeptides.

It is also an aim of the invention to provide methods for preventing infection with yeast or fungi.

It is a further aim of the invention to provide human homologues for the nucleic acids and polypeptides of the invention for use in treating proliferative disorders, such as cancer, or for the prevention of apoptosis in certain diseases, or for the preparation of a medicament for treating such disorders or diseases.

All the aims of the present invention have been met by the embodiments as set out below.

SUMMARY OF THE INVENTION

Since it has been discovered that the mammalian bax gene triggers apoptotic changes in yeast (Ligr et al., 1998), this can be an indication that the molecular pathways eventually leading to programmed cell death may also be partially present in yeast cells and other unicellular eukaryotes. Identification of genes involved in this process could be important for the development of new antifungal therapeutics.

The present inventors overexpressed the Bax protein in the pathogenic yeast *Candida albicans* and found that this leads to a similar phenotype. However these results could only be received after having constructed a new synthetic BAX gene which could be adequately expressed in this pathogenic organism.

Furthermore, the present inventors identified a range of specific nucleic acids which are involved in the molecular pathways eventually leading to programmed cell death. The present inventors were able to identify via macro array screening a range of genes involved in a pathway eventually leading to programmed cell death in the yeast *Saccharomyces cerevisiae*. Genes which were differentially expressed (analysed using the Pathways™ software) at different time points after Bax expression are envisaged as candidate genes in the present invention.

Additionally, the invention also relates to *Candida* spp. homologues of the *S. cerevisiae* candidate genes and their uses in stimulating or preventing cell death in yeast and fungi, especially pathogenic yeast and fungi are herewith envisaged.

Furthermore, also part of the invention are the human homologues of these apoptosis-associated *S. cerevisiae* nucleic acids and polypeptides and their potential use in treating proliferative disorders in human and other mammals.

DETAILED DESCRIPTION OF THE INVENTION

The present invention relates to the use of a nucleic acid molecule encoding a polypeptide which is involved in a pathway eventually leading to programmed cell death of yeast or fungi and which nucleic acid sequence is selected from, (a) a nucleic acid encoding a protein having an amino acid sequence as represented in any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, or encoding a functional equivalent, derivative or bioprecursor of said protein, (b) a nucleic acid encoding a protein having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, (c) a nucleic acid encoding a protein having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, (d) a nucleic acid comprising a sequence as represented in any of SEQ ID NOs 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 691, 693, 695, 697, 699, 701, 703, 705, 707, 709, 711, 713, 715, 717, 719, 721, 723, 725, 727, 729 and 731, (e) a nucleic acid which is more than 70% identical, preferably more than 75 or 80% identical, more preferably more than 85%, or 90% or 95% identical and most preferably more than 97% identical to any of the nucleic acid sequences as represented by any of SEQ ID NOs 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 691, 693, 695, 697, 699, 701, 703, 705, 707, 709, 711, 713, 715, 717, 719, 721, 723, 725, 727, 729 and 731, (f) a nucleic acid encoding a functional fragment of any of the nucleic acids as specified in a) to e); and (g) the complement of any of the nucleic acids as specified in a) to f), for the preparation of a medicament for treating diseases associated with yeast or fungi.

Sequence similarity searches were performed using the BLAST software package version 2. Identity and similarity percentages were calculated using BLOSUM62 as a scoring matrix. As known in the art, "similarity" between two polypeptides is determined by comparing the amino acid sequence and its conserved amino acid substitutes of one polypeptide to the sequence of a second polypeptide.

Moreover, also known in the art is "identity" which means the degree of sequence relatedness between two polypeptide or two polynucleotide sequences as determined by the identity of the match between two strings of such sequences. Both identity and similarity can be readily calculated. While there exist a number of methods to measure identity and similarity between two polynucleotide or polypeptide sequences, the terms "identity" and "similarity" are well known to skilled artisans (Carillo and Lipton, 1988). Methods commonly employed to determine identity or similarity between two sequences include, but are not limited to, those disclosed in "Guide to Huge Computers (Bishop, 1994) and Carillo and Lipton (1988). Preferred methods to determine identity are designed to give the largest match between the two sequences tested. Methods to determine identity and similarity are codified in computer programs. Preferred computer program methods to determine identity and similarity between two sequences include, but are not limited to, GCG program package (Devereux et al., 1984), BLASTP, BLASTN and FASTA (Altschul et al, 1990).

The expression functional fragment of a nucleic acid" as used herein means the minimal nucleic acid which is necessary to encode a functional protein (or polypeptide). For instance, in situations where a nucleic acid is provided comprising at the 5' end and at the 3' end more nucleotides than the actual open reading frame, the invention also relates to fragments of the nucleic acid which are smaller but which still contain the workable open reading frame. Also meant are parts of the open reading frame encoding a polypeptide having the same properties as the polypeptide encoded by the complete open reading frame.

The expression "a pathway eventually leading to programmed cell death" refers to a sequence of steps ultimately leading to cell death and which can be triggered at various steps in this pathway by various agents, such as Bax, Bak, CED4, hydrogen peroxide, diamide and farnesol. The nucleic acid sequences to be used according to this aspect of the invention from *Saccharomyces cerevisiae* are defined in SEQ ID NOs 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 691, 693, 695, 697, 699, 701, 703, 705, 707, 709, 711, 713 and 715; from *Candida albicans* are defined in SEQ ID NOs 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 718, 720, 722, 724, 726, 728, 730 and 732.

The yeast or fungi according to the invention may be, but are not restricted to, pathogenic yeast or fungi. As such, yeast or fungi may cause infections in healthy individuals as well as in immunocompromised patients.

The expression "treating diseases associated with yeast and fungi" not only refers to diseases or infections caused by said organisms but also refers to allergic reactions caused by said organisms, such as the so-called "professional diseases" in, for instance, bakery and brewery and that are caused by yeast or fungi which are commonly known as "non-pathogenic". Some examples of specific diseases associated with yeast or fungi are further exemplified.

The invention further relates to the use of nucleic acid sequence homologues of SEQ ID NOs 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 691, 693, 695, 697, 699, 701, 703, 705, 707, 709, 711, 713, 715, 717, 719, 721, 723, 725, 727, 729 and 731 but isolated from other yeast and fungi strains which are also involved in a pathway eventually leading to programmed cell death. According to a more specific embodiment, these nucleic acid sequences are derived from *Aspergillus fumigatus*.

In a more specific embodiment the invention relates to a nucleic acid encoding a polypeptide which is involved in a pathway eventually leading to programmed cell death of yeast or fungi selected from:

(a) a nucleic acid encoding a protein having an amino acid sequence as represented in any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, or encoding a functional equivalent, derivative or bioprecursor of said protein;

(b) a nucleic acid encoding a protein having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, (c) a nucleic acid encoding a protein having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, (d) a nucleic acid comprising a sequence as represented in any of SEQ ID 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 717, 719, 721, 723, 725, 727, 729 and 731;

(e) a nucleic acid which is more than 70% identical, preferably more than 75% or 80% identical, more preferably more than 85%, 90% or 95% identical and most preferably more than 97% identical to any of the nucleic acid sequences as represented by any of SEQ ID NO 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 717, 719, 721, 723, 725, 727, 729 and 731, (f) a nucleic acid encoding a functional fragment of any of the nucleic acid sequences as specified in a) to e), and, (g) the complement of any of the nucleic acids as specified in a) to f).

In a preferred embodiment the invention relates to nucleic acids from *Candida albicans*, as represented by the SEQ ID NOs 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 717, 719, 721, 723, 725, 727, 729 and 731.

In an even more preferred embodiment the invention relates to an isolated nucleic acid from mammal or human origin which nucleic acid corresponds to a mammal or human homologue of at least one of the sequences represented in SEQ ID NOs 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 687, 691, 693, 695, 697, 699, 701, 703, 705, 707, 709, 711, 713, 715, 717, 719, 721, 723, 725, 727, 729 and 731.

Therefore, according to a further preferred embodiment, the invention relates to an isolated nucleic acid from mammal or human origin which nucleic acid sequence is selected from:

(a) a nucleic acid encoding a protein having an amino acid sequence as represented in any of SEQ ID NOs 676, 678, 680, 682, 684 and 686, or encoding a functional equivalent, derivative or bioprecursor of said protein;

(b) a nucleic acid encoding a protein having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs 676, 678, 680, 682, 684 and 686;

(c) a nucleic acid encoding a protein having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 676, 678, 680, 682, 684 and 686;

(d) a nucleic acid comprising a sequence as represented in any of SEQ ID NOs 675, 677, 679, 681, 683 and 685;

(e) a nucleic acid which is more than 70% identical, preferably more than 75 or 80% identical, more preferably more than 85%, or 90% or 95% identical and most preferably more than 97% identical to any of the nucleic acid sequences as represented by any of SEQ ID NOs 675, 677, 679, 681, 683 and 685;

(f) a nucleic acid encoding a functional fragment of any of the nucleic acids as specified in a) to e); and (g) the complement of any of the nucleic acids as specified in a) to f), for the preparation of a medicament for treating diseases associated with yeast or fungi.

The invention also relates to the use of said nucleic acids for treating and/or preventing and/or alleviating proliferative disorders or for the prevention of apoptosis in certain disorders or diseases.

The expression "proliferative disorders" or "proliferative diseases" refers to an abnormality within a patient or animal such as cancer. Normal cells start to proliferate due to a change in the coding or non-coding sequence of the DNA resulting in a swollen or distended tissue. Mutation may arise without obvious cause. An abnormal benign or malignant mass of tissue is formed that is not inflammatory. Cells of pre-existent tissue start to divide unexpectedly and resulting cell mass possesses no physiologic function.

The expression "apoptosis" or "apoptosis-related diseases" includes diseases such as autoimmunity diseases, ischemia, diseases related with viral infections or neurodegenerations.

It should be clear that the invention also relates to all nucleic acids according to the invention and which are specifically described above, and which can be DNA, cDNA, genomic DNA, synthetic DNA, or RNA wherein T is replaced by U. A nucleic acid according to the invention may also comprise any modified nucleotide known in the art.

The term "nucleic acid sequence" also includes the complementary sequence to any single stranded sequence given.

According to the invention, these sequences and their homologues in other yeast and fungi or in human or other mammals as well as the polypeptides which they encode represent novel molecular targets which can be incorporated into an assay to selectively identify compounds capable of inhibiting or activating expression of such polypeptides. Furthermore, the invention also relates to the potential use of said sequences in alleviating diseases or conditions associated with yeast or fungi infections, such as diseases caused by *Candida* spp., *Aspergillus* spp., *Microsporum* spp., *Trichophyton* spp., *Fusarium* spp., *Zygomycetes* spp., *Botritis* spp., *Cladosporium* spp., *Malassezia* spp., *Epidermophyton floccosum*, *Blastomyces dermatitidis*, *Coccidioides immitis*, *Histoplasma capsulatum*, *Paracoccidioides brasiliensis*, *Cryptococcus neoformans*, and *Sporothrix schenckii*, such as, but not limited to:

Candidiasis, caused by *C. albicans* and other members of the genus *Candida*, which are primary or secondary mycotic infections, also named *candidosis, moniliasis* and thrush;

Aspergilliosis, caused by members of the genus *Aspergillus*, form a spectrum of diseases;

Histoplasmosis, caused by *Histoplasma capsulatum*, which is a pulmonary disease always seen in HIV positive or other immunocompromised individuals;

Paracoccidioidomycosis, caused by *Paracoccidioides brasiliensis*, which is a granulomatous disease that originates as a pulmonary disease;

Blastomycosis, caused by *Blastomyces dermatitidis*, which may be a benign and self-limiting infection or a chronic granulomatous and suppurative mycosis, also named Chicago disease or Gilchrist's disease;

Coccidioidomycosis, caused by *Coccidioides imminitis*, and which is a respiratory infection that typically resolves rapidly, but the mycosis can become acute, chronic, severe or fatal; also named San Joaquin Valley fever or Valley fever;

Cryptococcosis, caused by *Cryptococcus neoformans*, which is a chronic, subacute to acute pulmonary, systemic or meningitic disease, also named Torulosis;

Sporotrichosis, caused by *Sporothrix schenckii*, which is a chronic infection characterized by nodular lesions of cutaneous or subcutaneous tissues and adjacent lymphatics that suppurate, ulcerate and drain.

Some of the pathways leading to apoptosis are conserved between mammalian cells and yeast or fungi. Therefore the invention also relates to the potential use of homologous sequences from human or mammalian origin for preventing and/or alleviating diseases or conditions where apoptosis or non-apoptosis of cells is impaired, for instance in proliferative disorders. In this respect also cancer can be seen as a proliferative disorder. Furthermore, targets which are part of such a conserved pathway may be used to stimulate or inhibit the apoptosis in mammalian cells. E.g. stimulation of apoptosis is desirable in the treatment of tumor cells/tissues.

Human homologues according to the invention can be obtained by selective hybridisation of the yeast and candida nucleic acid molecules of the invention against human genome or cDNA libraries according to methods well known in the art (Sambrook et al., 1989). Human polypeptide homologues are obtained from the corresponding human nucleic acid homologous nucleotide sequences.

The present invention further relates to a nucleic acid capable of selectively hybridising to at least one of the nucleic acid molecules according to the invention, or the complement thereof.

The term "selectively hybridising" or "specifically hybridising" means hybridising under conditions wherein sequences can be detected which are homologues of the sequences of the invention, but which are for instance derived from heterologous cells or organisms, and wherein said sequences do not hybridize with known sequences. In a preferred embodiment, mammalian homologues can be detected. It is well known to the person skilled in the art which methods for hybridisation can be used and which conditions are necessary for selectively or specifically hybridising. Preferably, hybridization under high stringency conditions can be applied (Sambrook et al., 1989).

As such, the present invention also relates to the use of the nucleic acid sequences of the invention for detecting homologues in heterologous organisms including but not limited to mammalian organisms.

The invention also relates to an isolated nucleic acid comprising a human homologue of at least one of the yeast or candida nucleic acids described earlier. The invention also relates to a polypeptide encodable by said human homologue of said nucleic acid.

In a further embodiment the invention also relates to an expression vector comprising a human homologue of at least one of the yeast or candida nucleic acids described herein. Said expression vector according can be an expression vector wherein said nucleic acid sequence is operably linked to one or more control sequences allowing the expression in prokaryotic and/or eukaryotic host cells. According to a further embodiment, the expression vector comprises an inducible promoter and/or a reporter molecule.

The invention also relates to a host cell transformed, transfected or infected with any of the above described vectors.

According to a preferred embodiment, the invention relates to an antisense version of any of the nucleic acids of the invention and described above.

The present invention more particularly relates to an antisense molecule comprising a nucleic acid capable of selectively hybridising to at least one of the nucleic acids of the invention. In an interesting embodiment the invention relates to a nucleic acid capable of selectively hybridising to a human homologue of at least one yeast or candida nucleic acid described herein.

Polynucleotides according to the invention may be inserted into vectors in an antisense orientation in order to provide for the production of antisense RNA. Antisense RNA or other antisense nucleic acids may also be produced by synthetic means.

The present invention also advantageously provides nucleic acid molecules of at least approximately 10 contiguous nucleotides of a nucleic acid according to the invention and preferably from 10 to 50 nucleotides. These sequences may, advantageously be used as probes or primers to initiate replication, or the like. Such nucleic acid sequences may be produced according to techniques well known in the art, such as by recombinant or synthetic means. The probes will hybridise specifically with any of the nucleic acid molecules of the invention. The primers will specifically amplify any of the nucleic acid molecules of the invention. The probes or primers according to the invention may also be used in diagnostic kits or the like for detecting the presence of a nucleic acid according to the invention. These tests generally comprise contacting the probe with the sample under hybridising conditions and detecting the presence of any duplex or triplex formation between the probe and any nucleic acid in the sample.

According to the present invention these probes may be anchored to a solid support. Preferably, they are present on an array so that multiple probes can simultaneously hybridize to a single biological sample. The probes can be spotted onto the array or synthesized in situ on the array. (Lockhart et al., 1996). A single array can contain more than 100, 500 or even 1,000 different probes in discrete locations. Such arrays can be used to screen for compounds interacting with said probes.

Advantageously, the nucleic acid sequences, according to the invention may be produced using recombinant or synthetic means, such as for example using PCR cloning mechanisms which generally involve making a pair of primers, which may be from approximately 10 to 50 nucleotides to a region of the gene which is desired to be cloned, bringing the primers into contact with mRNA, cDNA, or genomic DNA from the yeast or fungal cell, performing a polymerase chain reaction under conditions which bring about amplification of the desired region, isolating the amplified region or fragment and recovering the amplified DNA. Generally, such techniques as defined herein are well known in the art, such as described in Sambrook et al. (1989). These techniques can be used to clone homologues of the nucleic acid sequences of the invention in other organisms.

The nucleic acids or oligonucleotides according to the invention may carry a revealing label. Suitable labels include radioisotopes such as $^{32}P$, $^{33}P$ or $^{35}S$, enzyme labels or other protein labels such as biotin or fluorescent markers. Such labels may be added to the nucleic acids or oligonucleotides of the invention and may be detected using techniques known in the art.

According to another embodiment of the invention, the nucleic acid sequences according to the invention as defined above may, advantageously, be included in a suitable vector, preferably an expression vector which may be transformed, transfected or infected into a host cell. In such an expression vector the nucleic acid is operably linked to one or more control sequences allowing the expresssison in host cells, such as a suitable promotor, or the like, to ensure expression of the proteins according to the invention in a suitable prokaryotic or eukaryotic host cell. Said promoter may be either constitutive, inducible or cell- or tissue- or organ-specific. The expression vector may advantageously be a plasmid, cosmid, virus or other suitable vector which is known to those skilled in the art. The expression vector and the host cell defined herein also form part of the present invention. Said host cell can be from bacterial, yeast, fungal, insect, mammal or human origin, or any other host wherein said vector can be introduced by at least one of the methods known in the art. However, preferred host cells are lower eukaryotic cells such as a yeast cell or a fungal cell. Yeast and fungal cells are particularly advantageous because they provide the necessary post-translational modifications to the expressed proteins of the invention, similar to those of the natural proteins from which they are derived. These modifications confer optimal conformation of said proteins, which when isolated may advantageously be used in kits, methods or the like.

In a further embodiment, the expression vector may further comprise an inducible promoter, and/or further a reporter molecule.

The invention further relates to any one of the nucleic acids as defined above for use as a medicament.

Nucleotide sequences according to the invention are particularly advantageous for providing selective therapeutic targets for treating yeast or fungi-associated infections. For example, an antisense nucleic acid capable of binding to the nucleic acid sequences according to the invention may be used to selectively inhibit expression of the corresponding polypeptides, leading to impaired growth or death of yeast and fungi with reductions of associated illnesses or diseases.

Also envisaged in the present invention are promoter or other control sequences that are comprised within the nucleic acids of the invention, said nucleic acid control sequences can also serve as a target for the identification of compounds or proteins which interfere with the control of expression of downstream encoded polypeptides.

Furthermore, also the human homologues of the yeast and candida nucleic acids may be useful in diseases where apoptosis of cells plays a substantial role, both in situations where apoptosis of (particular) cells is wanted or unwanted.

The invention thus also relates to the use of any of the nucleic acids of the invention or to a human homologue thereof for treating proliferative disorders or for the prevention of apoptosis in certain disorders or diseases. As described above, the invention also relates to the use of antisense molecules of the nucleic acids of the invention or to an antisense of any of the human homologues for treating proliferative disorders or for the prevention of apoptosis in certain disorders or diseases.

Said nucleic acids, human homologues and antisense molecules can also be used for the preparation of a medicament for treating or preventing the above-mentioned diseases.

According to yet another embodiment, the invention relates to at least one polypeptide encodable by a nucleic acid of the invention.

The invention also relates to the use of a polypeptide which is involved in a pathway eventually leading to programmed cell death of yeast or fungi, said polypeptide being selected from:

(a) a protein having an amino acid sequence as represented in any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, or encoding a functional equivalent, derivative or bioprecursor of said protein;

(b) a protein having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, (c) a protein having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 692, 694, 696, 698, 700, 702, 704, 706, 708, 710, 712, 714, 716, 718, 720, 722, 724, 726, 728, 730 and 732, and, (d) a functional fragment of any of said proteins as defined in a) to c), for the preparation of a medicament for treating diseases associated with yeast or fungi.

The term "functional fragment" of a protein means a truncated version of the original protein or polypeptide referred to. The truncated protein sequence can vary widely in length; the minimum size being a sequence of sufficient size to provide a sequence with at least a comparable function and/or activity of the original sequence referred to, while the maximum size is not critical. In some applications, the maximum size usually is not substantially greater than that required to provide the desired activity and/or function(s) of the original sequence. A functional fragment can also relate to a subunit with similar function as said protein. Typically, the truncated amino acid sequence will range from about 5 to about 60 amino acids in length. More typically, however, the sequence will be a maximum of about 50 amino acids in length, preferably a maximum of about 60 amino acids. It is usually desirable to select sequences of at least about 10, 12 or 15 amino acids.

Functional fragments include those comprising an epitope which is specific or unique for the proteins according to the invention. Epitopes may be determined using, for example, peptide scanning techniques as described in Geysen et al. (1986). Preferred functional fragments have a length of at least, for example, 5, 10, 25, 50, 75, 100, 125, 150, 175 or 200 amino acids.

The polypeptides to be used according to the invention from *Saccharomyces cerevisiae*, are represented by SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 692, 694, 696, 698, 700, 702, 704, 706, 708, 710, 712, 714 and 716. Also according to the invention is the use of the polypeptides from *Candida albicans* as represented by the SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, and the use of human polypeptides as represented by SEQ ID NOs 676, 678, 680, 682, 684 and 686.

Thus, according to a preferred embodiment, the present invention relates to an isolated polypeptide which is involved in a pathway for programmed cell death of yeast or fungi, for instance a *Candida* spp., selected from:
(a) a polypeptide having an amino acid sequence as represented in any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, or encoding a functional equivalent, derivative or bioprecursor of said protein;
(b) a polypeptide having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732,
(c) a polypeptide having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 688, 718, 720, 722, 724, 726, 728, 730 and 732, and
(d) a functional fragment of any of said polypeptides as defined in a) to c).

According to a further preferred embodiment, the present invention relates to an isolated polypeptide which is involved in a pathway for programmed cell death of mammalian cells selected from:
(a) a polypeptide having an amino acid sequence as represented in any of SEQ ID NOs 676, 678, 680, 682, 684 and 686, or encoding a functional equivalent, derivative or bioprecursor of said protein;
(b) a polypeptide having an amino acid sequence which is more than 70% similar, preferably more than 75% or 80% similar, more preferably more than 85%, 90% or 95% similar and most preferably more than 97% similar to any of the amino acid sequences as represented by any of SEQ ID NOs human 676, 678, 680, 682, 684 and 686;

(c) a polypeptide having an amino acid sequence which is more than 70% identical, preferably more than 75% or 80% identical, more preferably more than 85%, 90% or 95% identical and most preferably more than 97% identical to any of the amino acid sequences as represented by any of SEQ ID NOs 676, 678, 680, 682, 684 and 686; and, (d) a functional fragment of any of said polypeptides as defined in a) to c).

The invention also relates to the polypeptides of the invention and described above for use as a medicament.

Pharmaceutical or fungicidal compositions comprising at least one of the nucleic acids, antisense molecules, polypeptides of the invention optionally together with a pharmaceutically acceptable carrier, diluent or excipient therefor, are also part of the invention.

The polypeptides described above or the human or mammal homologues thereof can also be used for treating proliferative disorders or for the prevention of apoptosis in certain diseases.

The invention furthermore relates to a pharmaceutical composition for use as a medicament for treating proliferative disorders or for the prevention of apoptosis in certain diseases comprising a nucleic acid molecule of the invention or a human homologue thereof, an antisense molecule to at least one of the nucleic acids of the invention or an antisense molecule to a mammalian homologue of said nucleic acid or a polypeptide of the invention or a human homologue thereof together with a pharmaceutically acceptable carrier, diluent or excipient therefor.

The polypeptide or protein according to the invention may also include variants of any of the polypeptides of the invention as specified above having conservative amino acid changes.

The present invention also relates to a vaccine for immunizing a mammal comprising at least one (recombinant) nucleic acid molecule or at least one (recombinant) polypeptide of the invention in a pharmaceutically acceptable carrier. Preferred vaccines are those that can be used for immunization against infections caused by yeast and fungi. Other preferred vaccines can be used for immunizing mammals against proliferative disorders or for preventing apoptosis in certain diseases.

Pharmaceutically acceptable carriers include any carrier that does not itself induce the production of antibodies harmful to the individual receiving the composition. Suitable carriers are typically large, slowly metabolizing macromolecules such as proteins, polysaccharides, polylactic acids, polyglycolic acids, polymeric amino acids, amino acid copolymers; and inactive virus particles. Such carriers are well known to those of ordinary skill in the art.

A "vaccine" is an immunogenic composition capable of eliciting protection against infections caused by yeast or fungi, whether partial or complete.

Said vaccine compositions may include prophylactic as well as therapeutic vaccine compositions. When a vaccine is used for protecting individuals against certain infections or diseases, it is called a prophylactic vaccine. A vaccine may also be useful for treatment of an individual, in which case it is called a therapeutic vaccine.

The term "therapeutic" refers to a composition capable of treating infections caused by yeast or fungi or capable of treating proliferative disorders.

Also encompassed within the present invention are antibodies, monoclonal or polyclonal, capable of specifically binding to one or more epitopes of the polypeptides or proteins of the invention. The polypeptides of the invention are represented in SEQ ID NOs 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 290, 292, 294, 296, 298, 300, 302, 304, 306, 308, 310, 312, 314, 316, 318, 320, 322, 324, 326, 328, 330, 332, 324, 326, 328, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 692, 694, 696, 698, 700, 702, 704, 706, 708, 710, 712, 714, 716, 718, 720, 722, 724, 726, 728, 730 and 732.

The term "specific binding" implies that there is substantially no cross-reaction of the antibody with other proteins.

The antibodies according to the invention may be produced according to techniques which are known to those skilled in the art. Monoclonal antibodies may be prepared using conventional hybridoma technology as described by Kohler and Milstein (1979). Polyclonal antibodies may also be prepared using conventional technology well known to those skilled in the art, and which comprises inoculating a host animal, such as a mouse, with a protein or epitope according to the invention and recovering the immune serum. The present invention also includes fragments of whole antibodies which maintain their binding activity, such as for example, Fv, F(ab') and F(ab')$_2$ fragments as well as single chain antibodies.

The antibodies of the invention are capable of specifically binding to at least one of the yeast or candida polypeptides as defined earlier or to a human homologue thereof or to a specific epitope of said polypeptide or said human homologue. The invention also relates to the use of said antibodies in treating and/or preventing and/or alleviating proliferative disorders or for the prevention of apoptosis in certain diseases. Said antibodies may also be used for the preparation of a medicament for and/or preventing and/or alleviating proliferative disorders or for the prevention of apoptosis in certain diseases.

Antibodies according to the invention may also be used in a method of detecting the presence of a polypeptide according to the invention, which method comprises reacting the antibody with a sample and identifying any protein bound to said antibody. A kit may also be provided for performing said method which comprises an antibody according to the invention and means for reacting the antibody with said sample.

The antibodies according to the invention may be used as a medicament or may be comprised in a pharmaceutical composition. According to a more specific embodiment, the antibodies may be used in the preparation of a medicament for treating diseases associated with yeast and fungi where the yeast or fungus is chosen from, but not restricted to *Candida* spp., *Aspergillus* spp., *Microsporum* spp., *Trichophyton* spp., *Fusarium* spp., *Zygomycetes* spp., *Botritis*, spp., *Cladosporium* spp., *Malassezia* spp., *Epidermophyton floccosum, Blastomyces dermatitidis, Coccidioides imminitis, Histoplasma capsulatum, Paracoccidioides brasiliensis, Cryptococcus neoformans,* and *Sporothrix schenckii.*

The invention also relates to a method of preventing infection with yeast or fungi, comprising administering a composition containing at least one polypeptide of the invention to a mammal in effective amount to stimulate the production of protective antibody or protective T-cell response.

According to another embodiment, the present invention provides a method of identifying compounds or polypeptides which selectively inhibit, induce or interfere with the expression/production of the polypeptides encoded by the nucleotide sequences of the Invention, or compounds which selectively inhibit, activate or interfere with the functionality of polypeptides expressed from the nucleotide sequences according to the invention, or which selectively inhibit, induce or interfere with the metabolic pathways in which these polypeptides are involved. Compounds (or polypeptides) may carry agonistic or antagonistic properties. The compounds (and polypeptides) to be screened may be of extracellular, intracellular, biologic or chemical origin.

Different alternative methods for identification of said compounds or polypeptides form part of the present invention.

According to a specific embodiment the invention relates to a method of identifying compounds which selectively modulate expression or functionality of polypeptides involved in a pathway eventually leading to programmed cell death of yeast and fungi or in metabolic pathways in which said polypeptides are involved, which method comprises (a) contacting a compound to be tested with yeast or fungal cells transformed, transfected or infected with an expression vector comprising an antisense sequence of at least one of the nucleic acid sequences of the invention, which expression results in underexpression of said polypeptide, in addition to contacting one or more wild type cells with said compound, (b) monitoring the growth and/or death rate or activity of said transformed, transfected or infected cells compared to said wild type cells; wherein differential growth or activity of said transformed, transfected or infected yeast or fungal cells is indicative of selective action of said compound on a polypeptide in the same or a parallel pathway, (c) alternatively monitoring the growth and/or death rate and/or activity of said transformed, transfected or infected cells compared to transformed, transfected or infected cells which were not contacted with the compound to be tested, wherein differential growth or activity of said mutated yeast or fungi cells is indicative of selective action of said compound on a polypeptide in the same or a parallel pathway, (d) alternatively monitoring changes in morphologic and/or functional properties of components in said transformed, transfected or infected cells caused by the addition of the compound to be tested, and (e) optionally identifying the compound.

Alternative methods for identifying compounds which selectively modulate expression or functionality of polypeptides involved in a pathway eventually leading to programmed cell death of yeast or fungi or in metabolic pathways in which said compounds are involved, may comprise the use of any other method known in the art resulting in gene activation, gene inactivation, gene modulation or gene silencing.

Another alternative to the above described method comprises (a) contacting a compound to be tested with a genetically modified yeast or fungus in which modification results in the overexpression or underexpression of at least one of the nucleic acids or the polypeptides of the invention, which overexpression or underexpression of said nucleic acid or polypeptide prevents, delays or sensitizes for apoptosis of said genetically modified yeast or fungus, in addition to contacting wild type cells with said compound, (b) monitoring the growth and/or death rate and/or activity of said genetically modified yeast or fungi cells compared to said wild type cells wherein differential growth or activity of said genetically modified yeast or fungi cells is indicative of selective action of said compound on a polypeptide in the same or a parallel pathway, (c) alternatively monitoring the growth and/or death rate and/or activity of said genetically modified cells compared to genetically modified cells which were not contacted with the compound to be tested, wherein differential growth or activity of said genetically modified yeast of fungi cells is indicative of selective action of said compound on a polypeptide in the same or a parallel pathway, (d) alternatively monitoring changes in morphologic and/or functional properties of components in said genetically modified cells caused by the addition of the compound to be tested, and, (e) optionally identifying the compound.

The invention also relates to a method of identifying compounds which selectively modulate expression of polypeptides which are involved in a pathway eventually leading to programmed cell death of yeast or fungi which method comprises (a) contacting host cells transformed, transfected or infected with an expression vector comprising a promoter sequence of a nucleic acid molecule of the invention joined in frame with a reporter gene and (b) monitoring increased or decreased expression of said reporter gene caused by the addition of the compound being tested. This enables to analyse the influence of the compound onto all/most aspects of transcriptional activation. Alternatively additional tests can routinely be performed to test the influence of the compound onto mRNA stability, translation and protein stability. All these aspects influence the concentration of corresponding proteins and consequently influence the effect of these on the metabolism of the cell.

The invention further relates to a method of identifying compounds or polypeptides which bind to or modulate the properties of polypeptides which are involved in a pathway eventually leading to programmed cell death of yeast or fungi, which method comprises (a) contacting a compound or polypeptide to be tested with at least one of the polypeptides of the invention, (b) detecting the complex formed between the compound or polypeptide to be tested and said polypeptide, (c) alternatively, examining the diminution/increase of complex formation between said polypeptide and a receptor/binding partner, caused by the addition of the compound or polypeptide being tested, (c) alternatively, examining the alteration in the functional activity of the polypeptide, caused by the addition of the compound or polypeptide being tested, and (d) optionally identifying the compound or polypeptide.

The invention also relates to a method for identifying compounds interacting with a polypeptide involved in a pathway eventually leading to programmed cell death of yeast and fungi comprising the steps of (a) providing a two-hybrid screening system wherein a polypeptide of the invention and a protein interacting with said polypeptide or an interacting polypeptide obtainable by a method as described above, are expressed, (b) interacting said compound with the complex formed by the expressed proteins as defined in a), (c) detecting a second complex, wherein the presence of said second complex identifies a compound which specifically binds to one of said polypeptide or to said second complex, and optionally (d) identifying the compound. According to another embodiment the invention relates to a method for identifying compounds which selectively modulate expression of polypeptides which are involved in a pathway eventually leading to programmed cell death of yeast or fungi which method comprises: (a) contacting host cells transformed, transfected or infected with an expression vector comprising a promoter sequence of a nucleic acid of the invention joined in frame with a reporter gene, (b) monitoring increased or decreased expression of said reporter gene caused by the addition of the compound being tested, and, optionally (c) identifying the compound.

Yet another embodiment of the invention is a method for identifying polypeptides involved in a pathway eventually leading to programmed cell death comprising the steps of: (a) providing a two hybrid system wherein a polypeptide encoded by a nucleic acid or by any of the vectors of the invention as a bait and a *S. cerevisiae* cDNA library as a prey are used, (b) detecting an interaction between said polypeptide and a *S. cerevisiae* polypeptide encoded by said cDNA library, and, optionally (c) identifying said *S. cerevisiae* polypeptide.

The term "cells" as used in the above methods relates to any type of cells such as, but not limited to bacterial, yeast, fungal, plant or human cells.

Compounds found using this approach may additionally be tested on their efficiency in killing or inhibiting the growth of wild type cells in order to confirm their utility as medicament for treating wild type pathogenic strains/tumor cells.

According to the invention, the term "mutation" includes point mutations, deletions, insertions, duplications or any modification in the nucleic acid encoding said polypeptide, or at a different location in the genome of said cells, influencing the expression of said nucleic acid or polypeptide. In case point mutations occur, the number of nucleotides will be identical compared to the original sequence; only a change in nucleotide sequence can be observed. This stands in contrast with the other listed mutations where the number of the nucleotides will be different from the number observed in the wild type sequence and consequently will also reflect in a change of the nucleotide sequence.

Changes in morphologic and/or functional properties of cell components which can be monitored include for example morphological and molecular changes such as abnormal cell morphology, nuclear fragmentation, DNA breakage or changes in the expression of certain enzymes such as caspases, as well as monitoring changes in membrane potential or activity of mitochondria and release of cytochrome c from mitochondria. All these changes can be monitored on the whole cell which is contacted to the compound to be tested.

Detection of the complex formation can be performed using several approaches. First, binding of a compound onto a polypeptide can be studied using classical binding tests: one of the binding partners, compound or polypeptide is labeled and interaction of both is measured. Most of these tests comprise following steps: incubating both binding partners in conditions where binding is allowed, separation of free label from bound label present in the complex formed between both partners, and measuring the number of labeled complexes formed. Separation of free and bound label can be performed via filtration, centrifugation or other means as known by the person skilled in the art. Other techniques allow visualisation of complex formation without the need of such a separating step. For example, test systems using SPA (scincillation proximity assay) beads are based on the principle that radioactive $^3H$ can only be measured when present in scincillation fluid. SPA beads contain scincillation fluid and can be coated with one of the binding partners. When this bead is approached and binds the other binding partner which is radioactively labeled, a signal will be detected allowing the complex to be visualised. Binding of the radioactive compound onto the scincillation bead is needed in order to result in a detectable signal; non-bound radioactive partners that stay free into the solution will not result in a detectable signal.

The protein or peptide fragments according to the invention employed in such a method may be for example in solution or coated on suspended beads as described above. Alternatively, these can be affixed to a solid support, borne on a cell or phage surface or located intracellularly.

When protein or peptide fragments are coated on solid supports, they can be tested for their binding affinity for large numbers of compounds. These can be used in different kinds of high throughput screenings in order to identify compounds having suitable binding affinity to the polypeptides according to the invention. Platform technologies or technologies based on SPR (see below) can be applied.

One may measure for example, the formation of complexes between the proteins of the invention and the compound being tested. Alternatively, one may examine the diminution or increase of complex formation between the protein according to the invention and a receptor/binding partner caused by the compound being tested.

Proteins which interact with the polypeptide of the invention may be identified by investigating protein-protein interactions using the two-hybrid vector system first proposed by Chien et al. (1991).

This technique is based on functional reconstitution in vivo of a transcription factor which activates a reporter gene. More particularly the technique comprises providing an appropriate host cell with a DNA construct comprising a reporter gene under the control of a promoter regulated by a transcription factor having a DNA binding domain and an activating domain, expressing in the host cell a first hybrid DNA sequence encoding a first fusion of a fragment or all of a nucleic acid sequence according to the invention and either said DNA binding domain or said activating domain of the transcription factor, expressing in the host at least one second hybrid DNA sequence, such as a library or the like, encoding putative binding proteins to be investigated together with the DNA binding or activating domain of the transcription factor which is not incorporated in the first fusion; detecting any binding of the proteins to be investigated with a protein according to the invention by detecting for the presence of any reporter gene product in the host cell; optionally isolating second hybrid DNA sequences encoding the binding protein.

An example of such a technique utilizes the GAL4 protein in yeast. Gal4 is a transcriptional activator of galactose metabolism in yeast and has a separate domain for binding to activators upstream of the galactose metabolising genes as well as a protein-binding domain. Nucleotide vectors may be constructed, one of which comprises the nucleotide residues encoding the DNA binding domain of Gal4. These binding domain residues may be fused to a known protein encoding sequence, such as for example the nucleic acids according to the invention. The other vector comprises the residues encoding the protein-binding domain of Gal4. These residues are fused to residues encoding a test protein. Any interaction between polypeptides encoded by the nucleic acid according to the invention and the protein to be tested leads to transcriptional activation of a reporter molecule in a GAL4 transcription deficient yeast cell into which the vectors have been transformed. Preferably, a reporter molecule such as β-galactosidase is activated upon restoration of transcription of the yeast galactose metabolism genes. Alternatively, other reporter proteins can be used such as EGFP (enhanced green fluorescent protein), or hEGFP. This latter has a decreased lifetime enabling the system to screen for compounds improving the interaction of studied binding partners.

The two-hybrid approach was first developed for yeast, and is an ideal screening system when looking for compounds active in killing yeast or fungi. Indeed, proteins expressed in this system will most probably carry the correct modifications as found in the pathogenic yeast strains. In addition, compounds active in this test system allow to screen and select compounds which are able to enter the cell, this selection is not possible when using in vitro test systems. When compounds are needed to target mammalian cells, modification of the studied proteins can be different, changing the structure of corresponding proteins. Moreover working with yeast might block certain compounds to enter the cell, which are normally able to traverse the mammalian cell membrane. Consequently, working with mammalian two-hybrid system for this purpose will give already an immediate selection of the compounds that may enter mammalian cells.

Alternative in vitro methods can be used to investigate protein-protein interactions. Protein interaction analysis in vitro can shed light on their role in the intact cell by providing valuable information on specificity, affinity, and structure-function relation ship. Significant progress in this respect has become with the advent, in the last few years, of commercially available biosensor technology. This allows to study macromolecular interactions in real-time, providing a wealth of high-quality data that can be used for kinetic analysis, affinity measurements, competition studies, etc. A major advantage of biosensor analysis is that there is no requirement for labeling one of the interacting components and then separating bound from free molecules—a fact that simplifies experimental procedures and provides more accurate measurements. The principle of surface plasmon resonance (SPR) is based on the detection of a change of the refractive index of the medium when a compound or protein binds to an immobilised partner molecule. For the SPR technology, one needs to load one of the interacting partners to the chip surface, followed by the superfusion of the second binding partner or more molecules. The second partner can be available as purified product, but alternatively a complex suspension containing this partner can also be used. Interaction of two or more compounds can be analysed, alternatively, compounds can be identified interfering or increasing this binding affinity towards each other.

SPR is not restricted to protein-protein interactions; any macromolecule with a suitable size will change the refractive index of the medium in contact with the biosensor surface and therefore give a signal. Studies have been done with protein-DNA interactions, as well as protein-lipid interactions. Moreover intact viruses, and even cells, can also be injected over the biosensor surface, in order to analyse their binding to receptors, lectins, and so on.

Alternatively, NMR is also an excellent tool for a detailed study of protein-protein or DNA-protein interactions. Isotope edited or isotope filtered experiments whereby one compound is isotopically labeled with $^{15}N$ or $^{13}C$ are an ideal way to study these complexes. This method does not allow high throughput analysis of compounds interfering or enhancing molecular interactions. Nevertheless, medium or low throughput systems can be used to confirm results obtained by the high throughput assays or in cases where none of the binding partners are labeled. Other techniques which can be used to study interactions are: overlay, ligand blotting, band-shift, co-immuno-precipitation, size exclusion chromatography and microcalorimetry (In. "Protein targeting Protocols" Ed. Clegg R. A. Humana Press, Totowa, N.J.).

Compounds modulating pathways leading to apoptosis may change the activity of the polypeptide of the invention. Therefore screening tests may be setup looking for altered protein activity of the polypeptide of the invention. Based on the amino acid sequence a possible function of the polypeptide might be envisaged; activities can be confirmed and corresponding activity test can be started.

Alternatively additional tests can be performed to test the influence of the compound onto protein stability, post-translational modification, precursor processing and protein translocation. All these aspects influence the concentration and/or activity of corresponding proteins and consequently influence the effect of these onto the metabolism of the cell. Also here, medium or low throughput systems can be used to confirm results obtained by the high throughout assays. In cases compounds need to be found to target tumor cells, screening assays will have to be used focused on the stimulation of the apoptotic pathway. This invention therefore also relates to in vitro and in vivo model systems comprising tumor tissue or cells expressing the polypeptides according to the invention which can be used to screen for therapeutic agents. In vivo modelsystems allow to test for compound efficacity but also the toxicity of these compounds can be tested. The compounds identified using any of the methods described in the invention not only include compounds which exert their effect in promoting cell death of yeast and fungi, but also include compounds which prevent or delay cell death. The latter compounds can be used to prevent or delay apoptosis of endogenic yeast or fungi in humans and other mammals which may be caused by pathogens or toxic environmental components.

According to a preferred aspect of the invention, the yeast or fungi according to any of the methods described, are chosen from *Candida* spp., *Aspergillus* spp., *Microsporum* spp., *Trichophyton* spp., *Fusarium* spp., *Zygomycetes* spp., *Botritis*, spp., *Cladosporium* spp., *Malassezia* spp., *Epidermophyton floccosum, Blastomyces dermatitidis, Coccidioides imminitis, Histoplasma capsulatum, Paracoccidioides brasiliensis, Cryptococcus neoformans*, and *Sporothrix schenckii*.

The invention also relates to a compound identified using any of the methods of the invention. Compounds identifiable or identified using a method according to the invention, may advantageously be used as a medicament. The invention also relates to a method for treating diseases associated with yeast or fungi comprising admixing a compound obtainable by a method of the invention with a suitable pharmaceutically acceptable carrier.

The invention further relates to a method for preparing pharmaceutical composition for treating diseases associated with yeast or fungi comprising admixing a compound as identified above with a suitable pharmaceutically acceptable carrier. The invention also relates to said pharmaceutical composition.

The compounds or pharmaceutical compositions of the invention can be used for the preparation of a medicament to treat diseases or conditions associated with yeast and fungi infections, more preferably where the yeast or fungus is chosen from *Candida* spp., *Aspergillus* spp., *Microsporum* spp., *Trichophyton* spp., *Fusarium* spp., *Zygomycetes* spp., *Botritis*, spp., *Cladosporium* spp., *Malassezia* spp., *Epidermophyton floccosum, Blastomyces dermatitidis, Coccidioides imminitis, Histoplasma capsulatum, Paracoccidioides brasiliensis, Cryptococcus neoformans*, and *Sporothrix schenckii*.

These compounds may also advantageously be included in a pharmaceutical composition together with a pharmaceutically acceptable carrier, diluent or excipient therefor.

A medicament according to the invention not only relates to fungicidal and fungistatic compounds for treating humans or mammals but also relates to fungicides for treating plants.

According to yet another embodiment, the invention relates to a genetically modified yeast or fungus in which modification results in the overexpression or underexpression of at least one of the nucleic acids or the polypeptides of the invention, which overexpression or underexpression of said nucleic acid or polypeptide prevents, delays or sensitizes for apoptosis of said genetically modified yeast or fungus. These genetically modified organisms may have a positive effect on the endogenic flora of humans and other mammals. The genetically modified yeast or fungi can be included in a pharmaceutical composition or can be used for the preparation of a medicament for prophylactic or therapeutic use.

Also according to the invention is the use of a compound obtainable by a method of the invention, a pharmaceutical composition or a genetically modified organism as described above for the preparation of a medicament for modifying the endogenic flora of humans and other mammals.

According to another embodiment, the invention relates to a genetically modified mammalian cell or non-human organism in which modification results in the overexpression or underexpression of at least one of the nucleic acids of the invention or a human homologue thereof or at least one of the polypeptides of the invention or a human homologue thereof, which overexpression or underexpression of said nucleic acid or polypeptide prevents or delays apoptosis of said genetically modified mammalian cell or in said genetically modified non-human organism.

According to a preferred embodiment, the invention relates to a genetically modified mammalian cell or non-human organism as described above wherein said modification comprises the expression of an antisense molecule to at least one of the nucleic acids of the invention or an antisense molecule to a mammalian homologue of said nucleic acid.

The invention also relates to a method for identifying compounds for stimulating or inhibiting apoptosis comprising the use of at least one of the nucleic acid sequences of the invention or a human homologue thereof and/or at least one of the polypeptides of the invention or a human homologue thereof and/or a genetically modified mammalian cell or non-human organism as described in the invention.

Some examples of preferred human homologues of yeast and/or *Candida* spp. sequences which can be used in the above methods are represented in SEQ ID NOs 675 to 686.

The invention further relates to the compounds identifiable according to the above-described method and their use as a medicament.

The invention further relates to a method for preparing a pharmaceutical composition for treating proliferative disorders or for preventing apoptosis in certain diseases comprising admixing a compound identifiable according to the above-described methods with a suitable pharmaceutically acceptable carrier.

The invention also relates to the use of compounds obtainable by the above described methods for the preparation of a medicament for treating proliferative disorders or for preventing apoptosis in certain disorders.

Furthermore, the present inventors overexpressed the Bax protein in the pathogenic yeast *Candida albicans* and found that this leads to a similar phenotype. However these results could only be received after having constructed a new synthetic bax gene which could be adequately expressed in this pathogenic organism.

Therefore, the present invention relates to an isolated nucleic acid representing a synthetic BAX-gene for expression in *Candida* spp. selected from the group of:
  a) a nucleic acid comprising a sequence as represented by SEQ ID NO 1,
  b) a nucleic acid comprising a fragment of a sequence of SEQ ID NO 1 and encoding a functional fragment of the sequence represented by SEQ ID NO 2,
  c) a nucleic acid comprising a sequence as represented in any of SEQ ID NOs 3 to 10,
  d) a nucleic acid which is more than 75% identical, preferably more than 80%, 85%, 90% or 95% identical, most preferably more than 97% identical to the nucleic acid as represented by SEQ ID NO 1, or to a nucleic acid according to the nucleic acid as defined in b) or c), and
  e) a nucleic acid as defined in any one of (a) to (i) interrupted by intervening DNA sequences,
  or a nucleic acid representing the complement of any of said nucleic acids as defined in (a) to (d).

The synthetic BAX gene shows 73.7% identity with the gene coding for Bax-a. It should be clear that the present invention also relates to nucleic acids wherein other, also frequently used *Candida* spp. codons, are used instead of the choice made for the sequence represented in SEQ ID NO 1. (Table 8)

It should be clear that all nucleic acids according to the invention and which are specifically described above, can be DNA, cDNA, genomic DNA, synthetic DNA, or RNA wherein T is replaced by U.

According to another embodiment of the invention, the nucleic acid sequences according to the invention as defined above may, advantageously, be included in a suitable vector, preferably an expression vector which may be transformed, transfected or infected into a host cell. In such an expression vector the nucleic acid is operably linked to one or more control sequences allowing the expression in host cells, such as a suitable promotor, or the like, to ensure expression of the proteins according to the invention in a suitable prokaryotic or eukaryotic host cell. In this respect, a constitutive or an inducible promoter can be used.

As described in the examples, the invention also relates to nucleic acids and constructs comprising the synthetic BAX, or parts thereof, as a fusion with a carrier gene, such as, but not restricted to the yeast GFP gene. It is not necessary to include the complete gene of the fusion partner in the expression construct, so the invention relates to various fusion products which can result from the synthetic BAX gene and its fusion partner.

The expression vectors comprising the synthetic construct or fusion protein and the host cell defined herein also form part of the present invention. Said host cell can be from bacterial, yeast, fungal, insect, mammal or human origin. An interesting host cell according to the invention is a *Candida* spp. cell.

In another embodiment, the expression vector may further comprise an inducible promoter, and/or further a reporter molecule.

The invention also relates to a vector as described above for inducing programmed cell death in *Candida* spp.

The invention further also relates a genetically modified yeast or fungal cell as described above wherein said modification results in the onset of at least one pathway eventually leading to programmed cell death.

The invention also relates to a genetically modified *Candida* spp. cell wherein said modification results in the onset of at least one pathway eventually leading to programmed cell death According to a further embodiment, the invention relates to a method for identifying genes in *Candida* spp. which are differentially expressed in a pathway eventually leading to programmed cell death using a synthetic BAX gene, as described above, or a vector comprising said gene as described herein, or a genetically modified yeast or fungal cell as described above.

In this respect different model systems are envisaged. It has been shown in the present invention that expression of the synthetic BAX gene as a fusion protein more rapidly kills the host cells than when expressed without a fusion partner. Accordingly there will be a difference in which *Candida* spp. genes will be differentially expressed in each system. The invention thus relates to methods for identifying genes in *Candida* spp. which are differentially expressed in a pathway eventually leading to programmed cell death, wherein in said methods the host cells will need a longer or shorter time period for starving. Said time period is dependent on the expression construct or system used.

The invention further relates to a method for obtaining and identifying *Candida* spp. sequences (genes or polypeptides) involved in a pathway eventually leading to programmed cell death comprising the steps of:
 a) providing a two hybrid system wherein a polypeptide encoded by a nucleic acid as described above or a vector as described above as a bait and a *Candida* spp. cDNA library as a prey are expressed,
 b) detecting an interaction between said polypeptide and a *Candida* spp. polypeptide encoded by said cDNA library, and,
 c) identifying said *Candida* spp. polypeptide.

The invention also relates to a method for identifying inhibitors (or inhibitor sequences) of Bax-induced cell death comprising the steps of:
 a) providing a genetically modified organism as described above,
 b) expressing a cDNA library in said genetically modified organism, and,
 c) identifying a polypeptide or a cDNA which expression has a beneficial effect on the survival and/or growth of said genetically modified organism.

The invention further relates to a method for identifying Bax-resistant yeast or fungi comprising the steps of:
 a) providing (a) genetically modified yeast or fungi as described above,
 b) treating said genetically modified yeast or fungi with a mutagen,
 c) isolating resistant yeast or fungal cells, and,
 d) optionally identifying and/or characterizing mutated genes in said resistant yeast or fungal cells.

The invention further relates to any of the methods described above wherein said genetically modified organism is a *Candida* spp.

The invention also relates to an isolated *Candida* spp. nucleic acid identifiable by any of the methods described above.

The invention, now being generally described, may be more clearly understood by reference to the following examples, which are included merely for purposes of illustration of certain aspects and embodiments of the present invention and are not intended to limit the invention. The contents of all references referred to in this text are hereby incorporated by reference.

FIGURE AND TABLE LEGENDS

FIG. 1. *Saccharomyces cerevisiae* sequences based on information obtained from the Saccharomyces Genome Database (SGD) (SEQ ID NOs 17 to 396 and SEQ ID NOs 691 to 716)

Figures 2, 3:
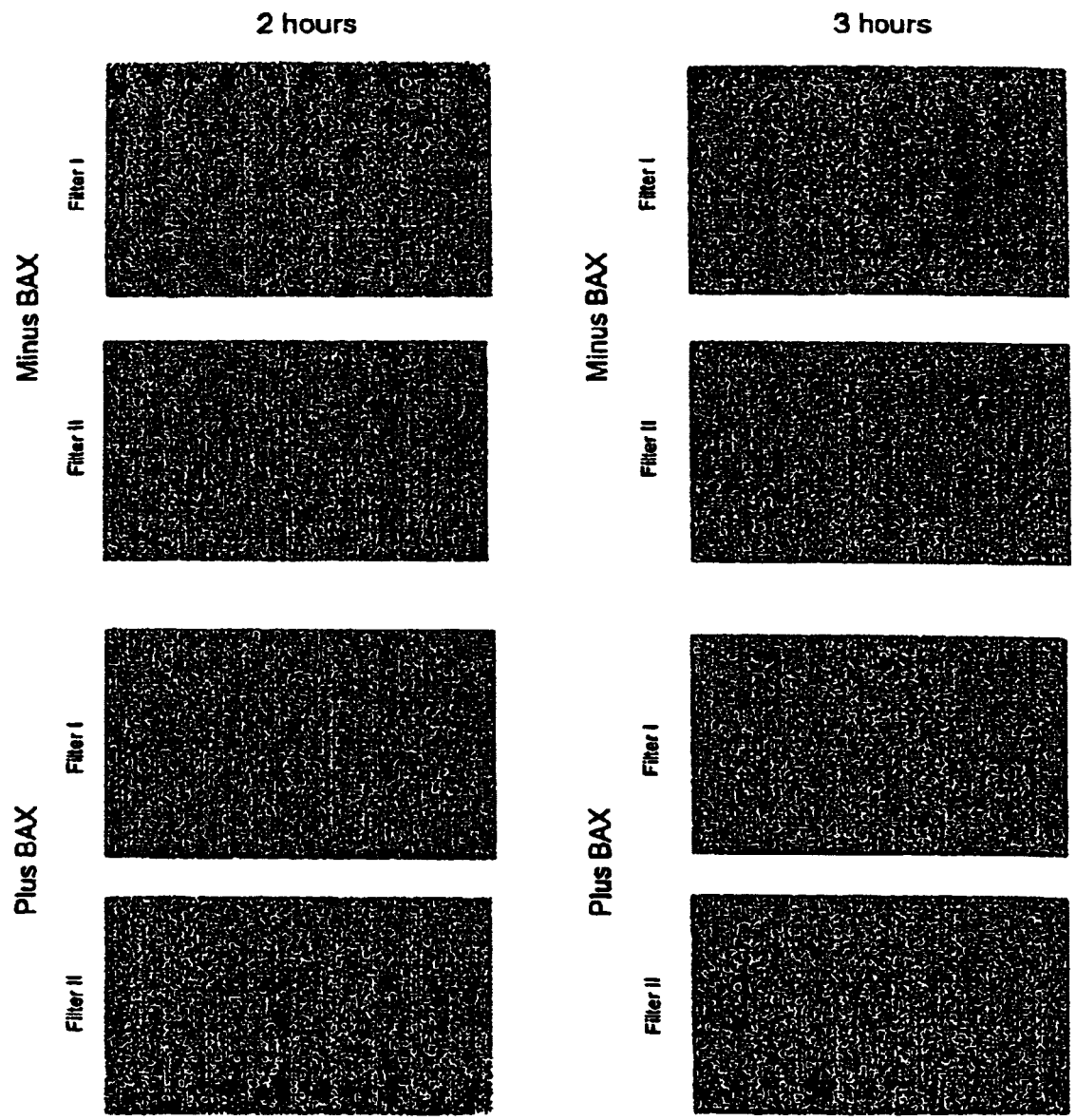
Figure 3:
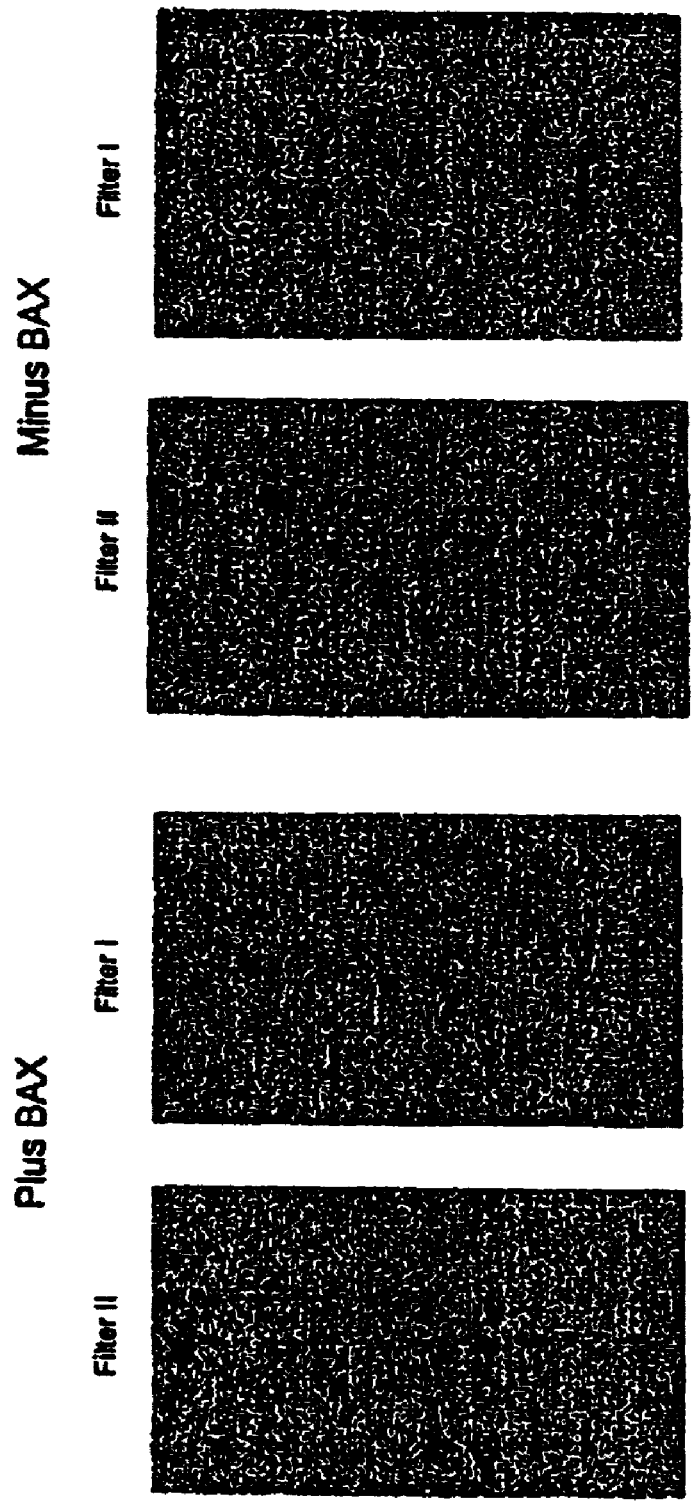

FIG. 2. *Candida albicans* (SEQ ID NOs 397 to 674, 687, 688 and 717 to 732) and human homologues (SEQ ID NOs 675 to 686).

Human homologues were confirmed via forward and reverse BLAST using BLOSUM62 as a scoring matrix.
 YGL080W (SEQ ID NO 161) codes for a yeast protein with an unknown cellular role and an unknown biochemical function. The human homologue (330 bp (SEQ ID NO 675), 109 aa (SEQ ID NO 676)) LOC51660/g7706369 has no reported cellular role or biochemical function.
 YGR243W (SEQ ID NO 189) codes for a yeast protein with an unknown cellular role and an unknown biochemical function. The human homologue (384 bp (SEQ ID NO 677), 127 aa (SEQ ID NO 678)) DKFZP564B167/g5817257 has no reported cellular role or biochemical function.
 YGR183C (QCR9) (Table 3) codes for a yeast protein with a known cellular role and a known biochemical function. QCR9 codes for subunit 9 of ubiquinol cytochrome-c reductase (7.3 kDa protein) which is a component of the ubiquinol cytochrome-c reductase complex. Cellular role: energy generation. Biochemical function: oxidoreductase and active transporter. The human homologue (132aa (SEQ ID NO 679), 399 bp (SEQ ID NO 680)) AF161536 was predicted to have an analogous cellular role and biochemical function.
 YBR009C (SEQ ID NO 37), YGR209C (SEQ ID NO 187) and YPR028W (SEQ ID NO 393) correspond to known yeast ORFs. Their human homologues have a reported cellular role or biochemical function.

FIG. 3. Yeast genome macroarray containing a total of 6144 gene ORFs spotted on 2 nylon membrane filters (I and II). Each filter contains 2 fields and each field is divided into 8 grids, organised in 24 rows and 8 columns.

The spots represent the genome wide expression profile without (Minus BAX) and with (Plus BAX) induction of Bax expression for 30 min, 1 hour, 2 hours, 3 hours and 6 hours.

Figure 4:
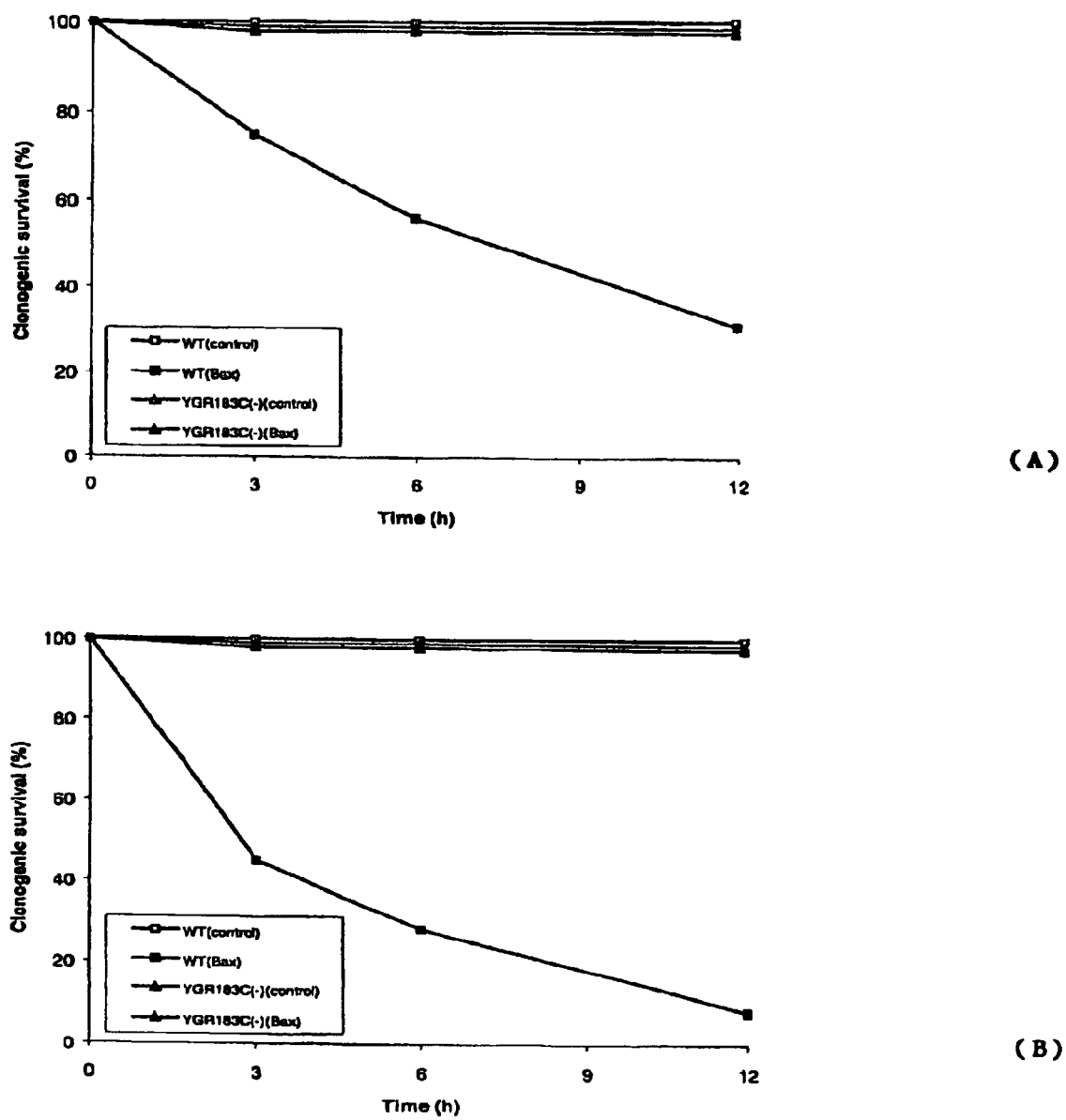

FIG. 4 Yeast cells with a disrupted YGR183C gene are fully resistant to Bax-induced cell death. Resistance is observed in both the low-copy (A) and the high-copy (B) Bax expression system. Clonogenic survival was determined by recovering cells at various times from galactose-containing medium and plating of 1000 cells on glucose-based semisolid medium. Data are representative of three experiments (mean±SD, n=3). SD bars are obscured by symbols.

Figure 5:
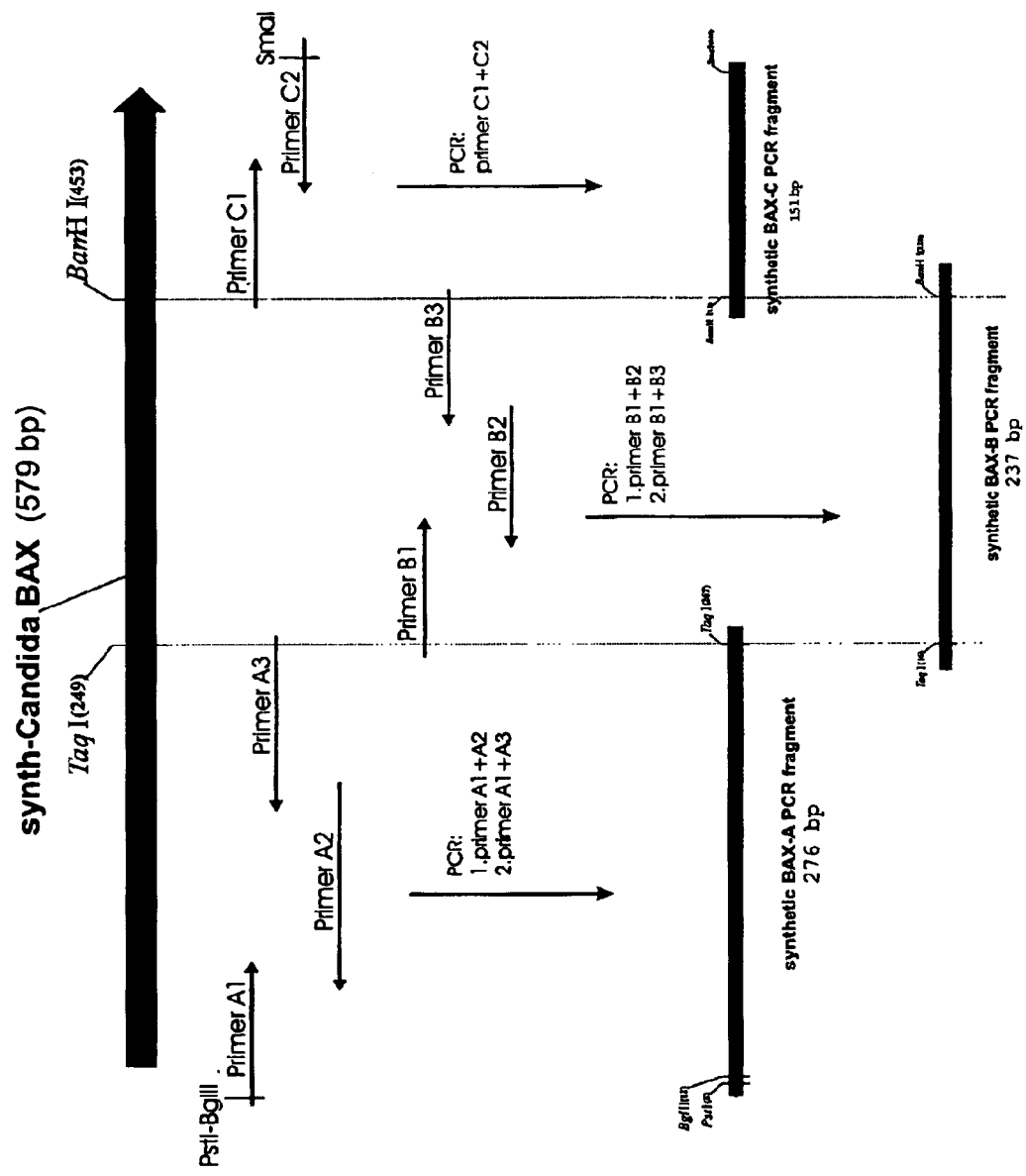
Figure 5:
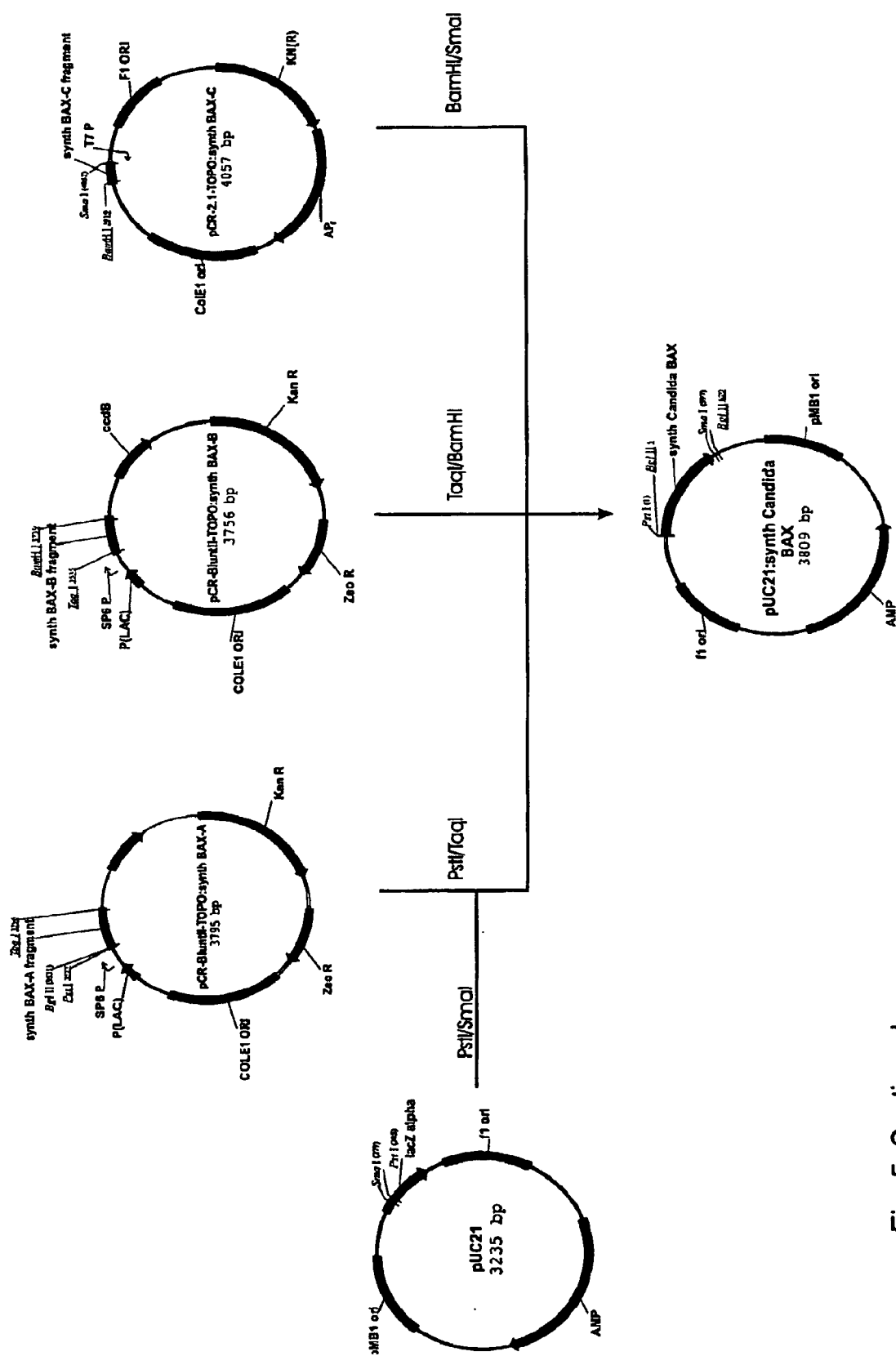

FIG. 5. Scheme for the synthesis of the synthetic BAX gene using *C. albicans* optimal codons.

FIG. 6. DNA (SEQ ID NO 1) and protein (SEQ ID NO 2) sequence of the synthetic *C. albicans* BAX gene.

Figure 7:
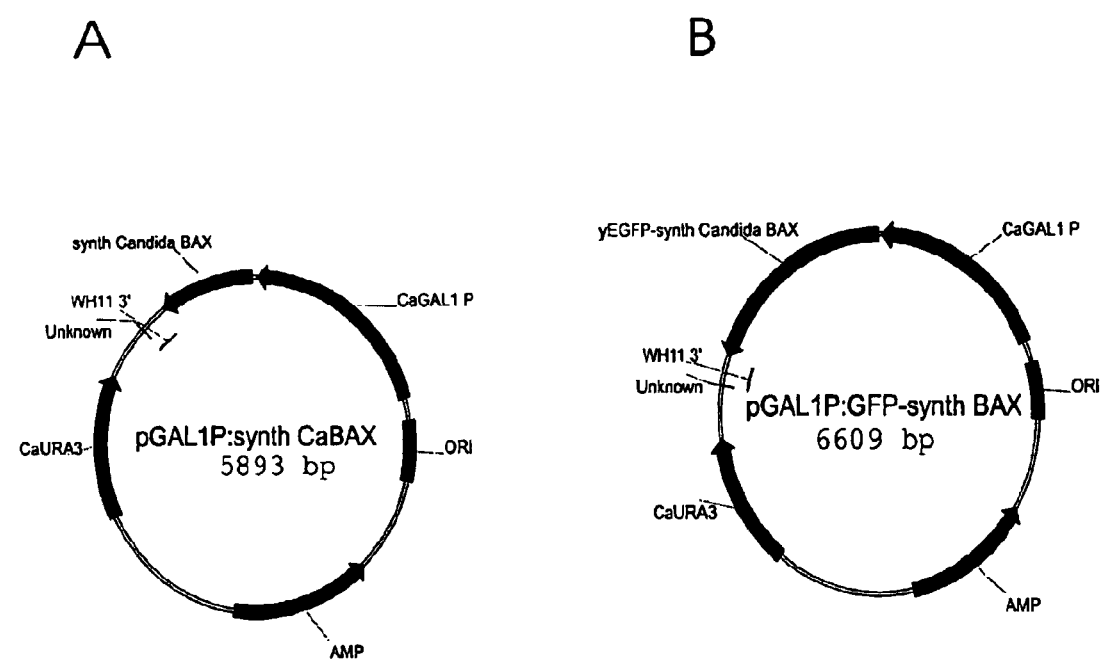

FIG. 7. Representation of the expression constructs of the synthetic CaBAX gene (A) and the yEGFP-synth CaBAX fusion (B).

Figure 8:

FIG. 8. Growth of the *Candida Albicans* transformants: the individual transformants of pGAL1P:synthCaBAX and pGAL1P:GFP-synthCaBAX were streaked onto plates containing either 2% glucose or 2% galactose as sole carbon source. Growth was monitored 4 days later.

FIG. 9. Growth kinetics of GAL1P:synthCaBAX (A) and GAL1P:GFP-synthCaBAX (B) on galactose containing minimal medium.

Figure 10:
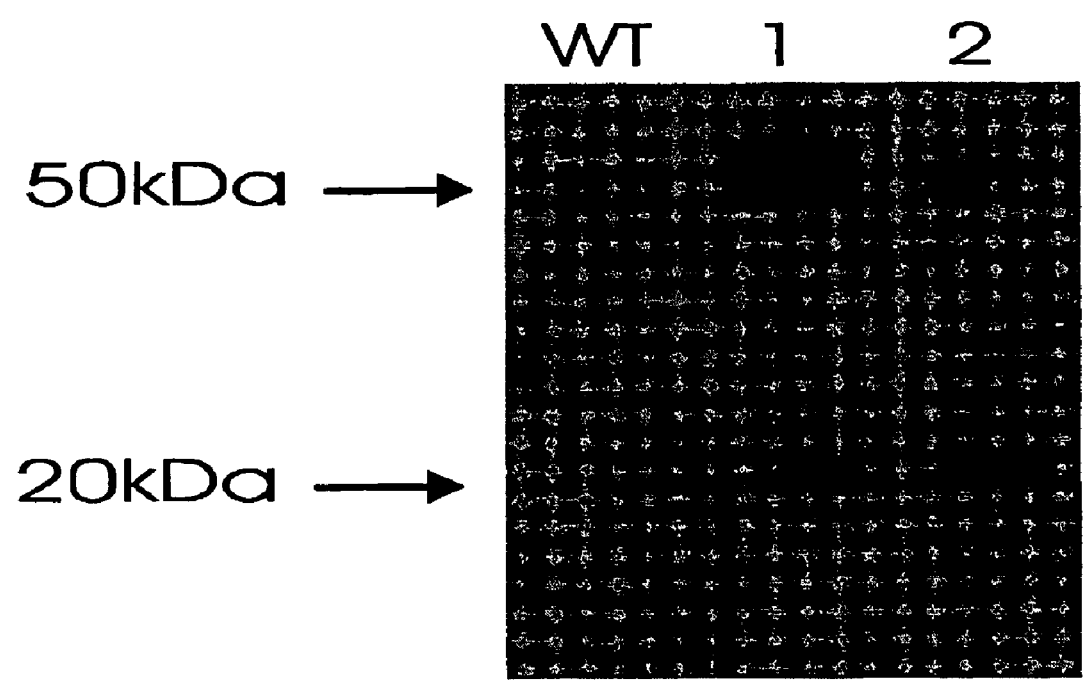

FIG. 10. Immunoblot analysis of two independent transformants of GAL1P:synthCaBAX after 15 hours Bax induction on minimal galactose containing media. The arrow at 20 kDa indicates the position of the Bax protein. The band seen at 50 kDa probably represents a cell wall mannan. Not all of the contamination of the polyclonal Bax antibody could be removed by the threatment with *S. cerevisiae* mannan.

Figure 11:
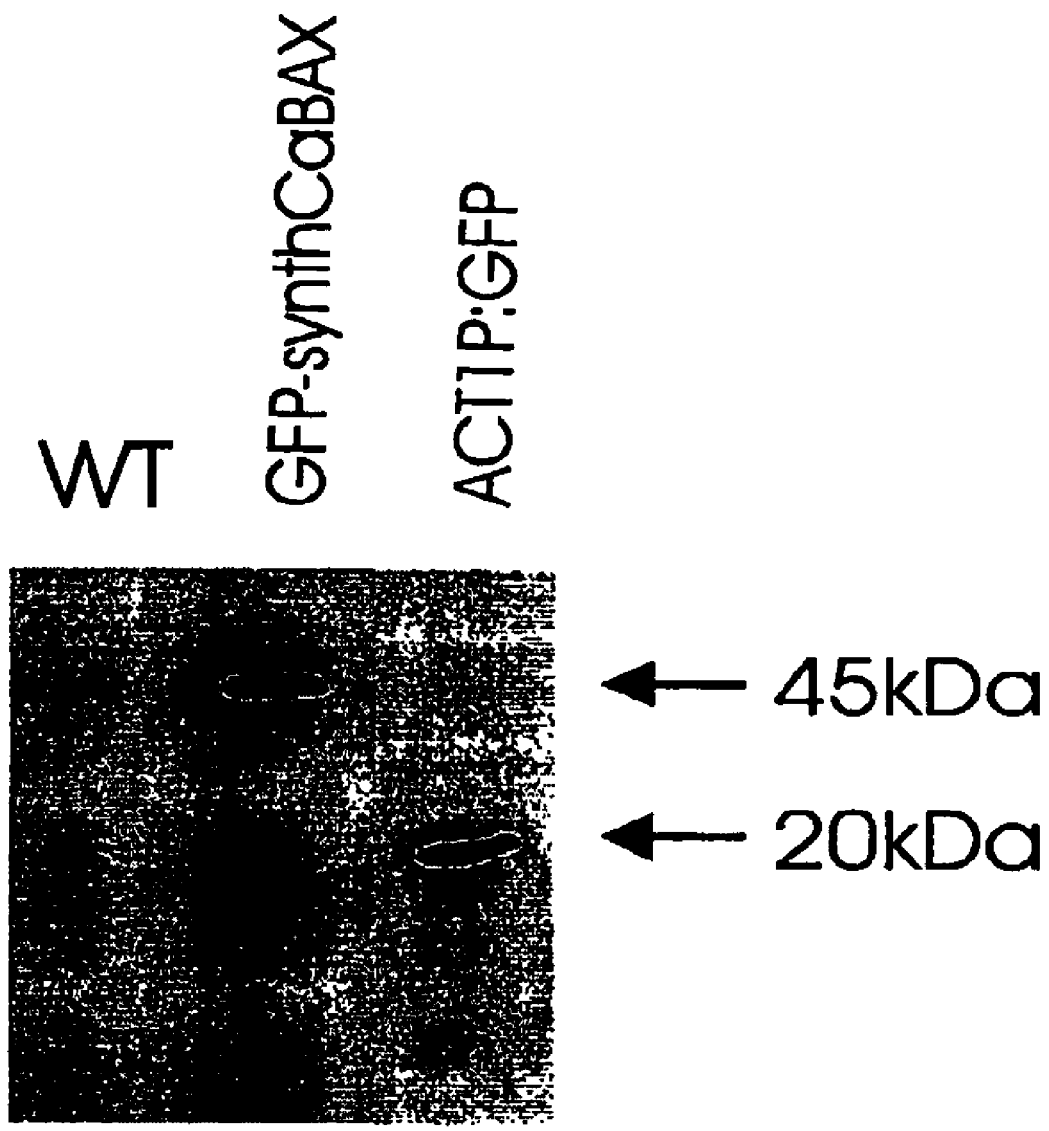

FIG. 11. Immunoblot analysis of the GAL1P:GFP-synthCaBAX strain on galactose containing minimal medium. The band appearing at 45 kDa represents the Gfp-Bax fusion protein, while the band at 20 kDa represents the Gfp protein alone.

FIG. 12. FACS analysis of two independent GAL1P:GFP-synthCaBAX transformants grown on galactose containing media: the light grey peak indicates the autofluorescence of the wt strain, the GFP-fluorescence peak is not shaded.

FIG. 13. Viability test synthCaBAX (A) and GFP-synthCaBAX transformants (B): Cells were pregrown in minimal dextrose medium and then switched to fresh minimal medium containing galactose. At the time points indicated, samples were taken and equal cell amounts were spread on minimal dextrose plates. The appearing colonies represented the viable fraction of the total pool.

Table 1. Oligonucleotides used for construction of the synthetic CaBAXx gene: start and stop codon are in bold, restriction sites used for cloning are in bold and italic.

Tables 2–6. Genes modulated by Bax expression in *S. cerevisiae*. This list includes the genes for which mRNA levels changed significantly after a 30 min (Table 2), 1 hour (Table 3), 2 hours (Table 4), 3 hours (Table 5) or 6 hours (Table 6) induction of Bax protein expression. The Qt values were calculated using the Pathways™ software (Research Genetics).

Table 7. Genes modulated by Bax expression in *S. cerevisiae*. This list includes all the genes for which mRNA levels changed significantly after induction of Bax protein expppression. The Qt values were calculated using the Pathways software (Research Genetics). Positive values correspond with upregulated genes. Negative values correspond with downregulated genes. (Comparable with ↑ and ↓ respectively in Tables 2–6).

Table 8. Codon usage for the synthetic BAX gene.

Table 9. Regulation of 23 selected "Bax-specific" functions.

EXAMPLES

Example 1

Differential Gene Expression Analysis Upon Bax-Induced Cell Death

Materials and Media

Bacterial strain *Escherichia coli* MC1061 (Casadaban and Cohen, 1980) was used for the construction and the amplification of plasmids. Yeast strains were grown under normal conditions on standard media (Sherman et al., 1979). The *Saccharomyces cereviseae* strain INVSc1 (Invitrogen®, San Diego, Calif., USA) was transformed by means of the lithium acetate method (Schiestl and Gietz, 1989) with YIpUTyL or YIpUTYLMuBax, after linearisation in the Ty δ element (Zhu, 1986).

Cloning of Mouse BAX cDNA

Mouse bax cDNA, encoding the mouse Bax-α protein, was cloned by Pfu DNA polymerase (Stratagene®, Lo Jolla, Calif., USA) chain reaction amplification (PCR) from an EL4/13.18 thymoma cDNA library (BCCM™/LMBP-LIB15) by making use of the primers:

```
5'-ATGGACGGGTCCGGGAGCAG-3'      (SEQ ID NO 689)
and

5'-TCAGCCCATCTTCTTCCAGATGGTGAG-3'. (SEQ ID NO 690)
```

The resulting PCR product was cloned in a HincII-openend pUC19 according to standard procedures (Sambrook J. et al., 1989).

Plasmid Constructions

The 2μ ori and the URA3 marker gene were removed from pUT332 (Gatignol et al., 1990) by successive digestions with ClaI and BglII. A BamHI-HindIII GAL1 promoter fragment was ligated into the BglII-HindIII-opened plasmid. A XbaI-FspI FLP terminator fragment was inserted into this XbaI-HindIII(blunted)-opened plasmid so that the plasmid YIpUT was obtained. Insertion of a blunted EcoRI-BsaAI Ty δ element in the KpnI-AatII-opened and blunted YIpUT resulted in the plasmid YIpUTy. Subsequent insertion of the LEU2 marker gene, as a blunted BsaAI-BsrGI fragment, in the BamHI-openend and blunted YIpUTy resulted in the plasmid YIpUTyL.

Mouse bax cDNA was excised from pUC19 by digestion with XbaI and HindIII and subcloned into the XbaI-HindIII-opened plasmid YIpUTyL, obtaining the final expression plasmid YIpUTyLMuBax.

The plasmid YIpUTyLMuBax has been deposited in the BCCM™/LMBP culture collection as pSCTyGALmBax with accession number 3871 under restricted use.

GeneFilters

The Yeast GeneFilters™ were purchased from Research Genetics Inc. (Huntsville, Ala., USA).

The Yeast GeneFilters™ are hybridization ready nylon membranes containing a total of 6144 gene ORFs (Open Reading Frames) individually amplified by PCR and spotted on 2 nylon membrane filters (Filter I and II). The filters are cut in the upper right corner and the DNA is on the labeled side of the filter.

Filter I contains 3072 ORFs organized into two fields (fields 1 and 2). Each field contains 1536 ORFs divided into 8 grids (A, B, C, D, E, F, G and H). The grids are organized in 24 rows and 8 columns.

Filter II contains 3072 ORFs organized in two fields (field 3 and 4). Fields 3 and 4 are organized in the same way as fields 1 and 2.

The Yeast ORF Target

The yeast filters consist of over 6144 PCR products corresponding to 6144 yeast ORFs derived from the SGD. The PCR reactions used ORF specific primer pairs designed to amplify the entire open reading frame. The primers were generated from unique sequences containing the start codon ATG and termination codon (kindly provided by M. Cherry at Stanford Genome Center). Thus the PCR product contains the complete open reading frame including the start and stop codons. These products were purified and resuspended at 50 nanograms per microliter in a colored solution to allow the printing to be monitored. A robotic device was used to spot approximately 1/10 of a microliter of the denatured PCR product solution on a positively charged nylon membrane. The DNA was then UV cross-linked to the membrane.

Results

Induction of Bax-Expression in Yeast Cells

A preculture of yeast strain INVSc1 containing YIpUTyLMuBax, wherein 5 Bax cassettes under the control of the GAL1 promotor are integrated in the genome near Ty δ elements, was grown overnight in minimal glucose-containing medium in parallel with the yeast strain INVSc1 containing YIpUTyL as a control. The precultures were diluted in 100-ml minimal glucose-containing medium and grown until an $OD_{600}$ of 1 was reached. Subsequently, the yeast cells were transferred into 100-ml galactose-containing medium and incubated for an additional period of 30 min, 1 hour, 2 hours, 3 hours or 6 hours.

RNA Isolation

Total RNA was isolated using RNApure™ Reagent (Genhunter Corporation Nashville, Tenn., USA) according to the GenHunter protocol. 1.5 $10^9$ cells were concentrated in a microcentrifuge tube and 1 ml RNApure™ Reagent was added together with 1 g of glass pearls. The yeast cells were broken by thorough mixing during five 2-minutes periods, and placed on ice in-between to avoid RNA degradation. Chloroform (150 μl) was added to the lysate and centrifuged for 10 min at 4° C. and at 15000 rpm. The supernatant was transferred to a new tube and the RNA was precipitated with an equal volume of isopropanol. After 10 min incubation on ice, the RNA was pelleted by centrifugation and the pellet was washed with 70% ice-cold ethanol. The dried RNA pellet was resuspended in 50 pi RNAse free $dH_2O$.

First Strand cDNA Synthesis in the Presence of α-$^{33}$P dCTP

Probes with high specific activity were prepared by first strand cDNA synthesis using total RNA isolated from INVSc1 YIpUTyLMuBax or INVSc1 YIpUTyL yeast cells and incorporation of α-$^{33}$P dCTP as follows: 2 μl (1 μg/ml) of Oligo dT was added to 20 μg of total RNA in a maximal volume of 8 μl RNase-free $dH_2O$ and incubated at 70° C. for 10 min. After cooling down on ice for 1 min, the following components were added:

- 6 μl 5× concentrated First Strand Buffer (GIBCO-BRL, Paisley, UK)
- 1 μl 0.1 M DTT
- 1 μl RNase Block (40 units/μl) (Stratagene)
- 1.5 μl 20 mM dXTP-solution (X=A, G and T) (Amersham Pharmacia biotech Uppsala, Sweden)
- 1.5 μl SuperScript™ Reverse Transcriptase (200 units/μl) (GIBCO-BRL)
- 10 μl α-$^{33}$P dCTP (10 mCi/ml, 3000 Ci/mmol) (Amersham Pharmacia biotech Uppsala, Sweden), and incubated for 2 h at 37° C. during which first strand cDNA synthesis took place.

Unincorporated label was separated from the probe on a Sephadex G-50 column (Amersham Pharmacia biotech Uppsala, Sweden). The radioactivity incorporated in the probe was measured by liquid scintillation. The specific activity of the probes was $5.10^8$ cpm/μg for both the INVSc1YIpUTyL and the INVSc1 YIpUTyLMuBax probes.

Additionally, the length of first strand cDNA probes was controlled on an alkaline 2% agarose gel using standard electrophoresis techniques, and resulted in the detection, via stimulated phosphorescence autoradiography, of the bulk of the fragments around 500 bp.

Hybridisation with the S. cerevisiae Yeast GeneFilters™ and Signal Detection

The Yeast GeneFilters™ were successively hybridised with the α-$^{33}$P dCTP labelled cDNA probes using the MicroHyb™ solution provided by the manufacturer (Research Genetics Inc., Huntsville, Ala., USA). This solution was applied as well in the prehybridisation step as during hybridisation. The MicroHyb™ solution contains formamide to allow hybridisation to occur at lower temperatures.

The hybridisation experiment was performed essentially as follows: during prehybridisation, the Yeast GeneFilters™ were placed in a hybridisation flask (35×250 mm) filled with 5 ml MicroHyb™ solution (42° C.) containing 5 μl polydA (1 μg/ml) and incubated for 24 hours at 42° C. whilst rotating (10 rpm). After disposal of the prehybridisation solution, the denatured (3 min at 100° C.) cDNA was added in 5 ml prewarmed MicroHyb solution and again incubated overnight at 42° C. whilst rotating. Following two wash steps of 20 min in wash buffer (2×SSC, 1% SDS) at 50° C., a third wash step was performed in a second wash buffer (0.5×SSC, 1% SDS) for an additional 15 min at room temperature. The Yeast GeneFilters™ were placed in a Phosphorimager™ cassette (Molecular Dynamics, Sunnyvale, Calif., USA) with storage phosphor screen. After 4 days of development the screen was scanned at a resolution of 50 μm using the (BioRad, Richmond, Calif., USA) Personal FX. The results of these can be seen in FIG. 3.

Example 2

Quantification of Hybridisation Signals

Quantification of the hybridisation signals was done using the Pathways™ software (Research Genetics, Huntsville, Ala., USA) and these signals were normalised against all data points. Comparison of these normalised data revealed differentially expressed candidate genes. Visual inspection of the hybridisation spots confirmed their selection. The genes as well as the factors with which they are up- or down-regulated are listed in the Tables 2 to 6 for each individual time point. An overview of the up and down regulated genes modulated in function of induction of Bax expression for several time points is shown in Table 7. The sequences of these genes and amino acid sequences that they encode are shown in FIG. 1.

Example 3

Comparative Gene Expression Analysis Upon Bax-Induced Cell Death and $H_2O_2$-Induced Cell Death The Oxidative $H_2O_2$-Challenge A preculture of yeast strain INVSc1 containing YIpUTyL was grown overnight in minimal glucose-containing medium. The preculture was diluted in 100-ml minimal glucose-containing medium and grown until an $OD_{600}$ of 1 was reached. Subsequently, the yeast cells were transferred into 100-ml galactose-containing medium supplemented with 0.1 mM $H_2O_2$, and incubated for an additional period of 1 hour. This oxidative challenge resulted in the same final toxicity as a 1-hour induction of Bax expression in the same growth conditions.

First Strand cDNA Synthesis in the Presence of α-$^{33}$P dCTP

RNA was isolated as mentioned in Example 1. Probes with high specific activity were prepared (detailed in Example 1) by first strand cDNA synthesis using total RNA isolated from INVSc1 YIpUTyLMuBax or INVSc1 YIpUTyL (growth conditions as described in Example 1) or oxidatively stressed INVSc1 YIpUTyL yeast cells.

The specific activity of all probes was $5.10^8$ cpm/μg.

Quantification of Hybridisation Signals

Hybridisation and signal detection as described in Example 1. Conversion of the digital images to a 16 bit TIFF format using the Quantity One program (BioRad, Hercules, Calif., USA) preserved image data and was necessary for file import into the Pathways® software (Research Genetics, Huntsville, Ala., USA). Pathways® was used for the quantification of hybridisation signals and these signals were normalised against all data points.

Identification of Bax-Responsive Genes

Pairwise comparisons of the normalised data obtained from INVSc1 YIpUTyLMuBax (B) and INVSc1 YIpUTyL (C) revealed differentially expressed genes. To determine the -fold induction or repression, the normalised signal intensity after Bax induction (B) was divided by that before the shock (C). Visual inspection of the hybridisation spots confirmed their selection (replacement).

Identification of Bax-Specific Genes within the Bax-Responsive Pool

Pairwise comparisons of the normalised data obtained from INVSc1 YIpUTyLMuBax (B) and INVSc1 YIpUTyL (C) at the 1-hour time point revealed differentially expressed genes. Linear ratios (B vs C) were estimated significant when changes were at least two-fold and the normalised signal intensity of one spot was at least tenfold above the average background value. The normalised data of the Bax-responsive genes were compared with data obtained from the $H_2O_2$-stressed INVSc1 YIpUTyL (H). A Bax-responsive (up-regulated/down-regulated) gene was considered to be Bax-specific when the normalised signal intensity after Bax induction was at least twice as high/low as the corresponding intensity after oxidative stress. Visual inspection of the hybridisation spots confirmed their selection. An overview of the Bax-specific genes for the 1-hour time point is shown in Table 9. The sequences of these genes and amino acid sequences that they encode are shown in FIG. 2.

Example 4

Search for Homologues in *Candida albicans* and Human

Sequence similarity searches against public and commercial sequence databases were performed with the BLAST software package (Altschul et al., 1990) version 2. Both the original nucleotide sequence and the six-frame conceptual translations were used as query sequences. The used public databases were the EMBL nucleotide sequence database (Stoesser et al., 1998), the SWISS-PROT protein sequence database and its supplement TrEMBL (Bairoch and Apweiler, 1998), and the ALCES *Candida albicans* sequence database (Stanford University, University of Minesota). The commercial sequence database used was the PathoSeq™ microbial genomic database (Incyte Pharmaceuticals Inc., Palo Alto, Calif., USA).

Sequence similarity searches were performed using the BLAST software package version 2. The identity between 2 sequences was calculated as percentage identical residues, the similarity percentage between two sequences was calculated using BLOSUM62 as a scoring matrix.

The sequences of homologues *Candida* spp. and human genes and the corresponding amino acid sequences are shown in FIG. 2.

Example 5

Screening for Compounds Modulating Expression of Polypeptides Involved in Induction of Cell Death of *C. albicans*

The method proposed is based on observations (Sandbaken et at, 1990; Hinnebusch and Liebman 1991; Ribogene PCT WO 95/11969, 1995) suggesting that underexpression or overexpression of any component of a process (e.g. translation) could lead to altered sensitivity to an inhibitor of a relevant step in that process. Such an inhibitor should be more potent against a cell limited by a deficiency in the macromolecule catalyzing that step and/or less potent macromolecule, as compared to the wild type (WT) cell.

Mutant yeast strains, for example, have shown that some steps of translation are sensitive to the stoichiometry of macromolecules involved. (Sandbaken et al, 1990). Such strains are more sensitive to compounds which specifically perturb translation (by acting on a component that participates in translation) but are equally sensitive to compounds with other mechanisms of action.

This method thus not only provides a means to identify whether a test compound perturbs a certain process but also an indication of the site at which it exerts its effect. The component which is present in altered form or amount in a cell whose growth is affected by a test compound is potentially the site of action of the test compound.

The assay to be set up involves measurement of growth and/or death rate of an isogenic strain which has been modified only in a certain specific allele, relative to a wild type (WT) *Candida albicans* strain, in the presence of R-compounds. Strains can be ones in which the expression of a specific protein is impaired upon induction of anti-sense or strains which carry disruptions in an essential gene. An in silico approach to find novel genes in *Candida albicans* will be performed. A number of essential genes identified in this way will be disrupted (in one allele) and the resulting strains can be used for comparative growth and/or death rate screening.

Example 6

Assay for High Throughput Screening for Drugs

35 μl minimal medium (S medium+2% galactose+2% maltose) is transferred in a transparent flat-bottomed 96 well plate (MW96) using an automated pipetting system (Multidrop, Labsystems, Helsinki, Finland). A 96-channel pipettor transfers 2.5 μl of R-compound at $10^{-3}$ M in DMSO from a stock plate into the assay plate.

The selected *Candida albicans* strains (mutant and parent (CAI-4) strain) are stored as glycerol stocks (15%) at −70° C. The strains are streaked out on selective plates (SD medium) and incubated for two days at 30° C. For the parent strain, CAI-4, the medium is always supplemented with 20 μg/ml uridine. A single colony is scooped up and resuspended in 1 ml minimal medium (S medium+2% galactose+ 2% maltose). Cells are incubated at 30° C. for 8 hours while shaking at 250 rpm. A 10 ml culture is inoculated at 250.000 cells/ml. Cultures are incubated at 30° C. for 24 hours while shaking at 250 rpm. Cells are counted in Coulter counter and the final culture (S medium+2% galactose+2% maltose) is inoculated at 20.000 to 50.000 cells/ml. Cultures are grown at 30° C. while shaking at 250 rpm until a final $OD_{600}$ of 0.24 (+/−0.04) is reached.

200 μl of this yeast suspension is added to all wells of MW96 plates containing R-compounds in a 450 p, total volume. MW96 plates are incubated (static) at 30° C. for 48 hours.

Optical densities are measured after 48 hours.

Test growth is expressed as a percentage of positive control growth for both mutant (x) and wild type (y) strains. The ratio (x/y) of these derived variables is calculated.

Example 7

Yeast Cell Viability Assay Upon Induction of Bax Expression

Materials and Media

Yeast stains were grown under normal conditions on standard media (Sherman et al., 1979). The *Saccharomyces cerevisiae* BY4742 wild type strain and BY4742 with the YGR183C gene disruption (EUROSCARF collection) were transformed by means of the lithium acetate method (Schiestl and Gietz, 1989) with the low-copy centromeric pRS415Bax plasmid or pRS415 as a control, or with the high-copy episomal pRS425Bax plasmid or pRS425 as a control.

Plasmid Constructions

The Bax expression cassette, a BsgI(blunted)-SapI (blunted) fragment excised from YIpUTyLMuBax containing the GAL1 promoter, the bax cDNA and the FLP terminator, was ligated into the Ec/136II-opened pRS415 (ATCC 87520) and pRS425 (ATCC 77106) plasmids, obtaining the low-copy centromeric pRS415Bax and the high-copy episomal pRS425Bax expression plasmids.

Results

Single colonies of yeast cells transformed with pRS415 or pRS415Bax or pRS425 or pRS425Bax were grown in 10 ml minimal glucose-containing medium with vigorous aeration at 30° C. to an optical density of 1 $OD_{600}$. Cells were pelleted by centrifugation and washed two times with sterile $dH_2O$ before resuspending in 10 ml minimal galactose-containing medium. After culturing for various times at 30° C., the total cell density of the cultures was determined, and 1000 cells were spread on minimal glucose-based semisolid medium, followed by incubation at 30° C. for 3 days. The number of colonies on plates from the 0 hr cultures was designated as 100% (FIG. 4).

Example 8

Bax Expression in *Candida* Cells

Strains

The *Candida albicans* strain CAI4 (ura3≅) was used to perform the experiments (Fonzi and Irwin 1993).

*E. coli* transformations were done using the Top 10 strain from Invitrogen (San Diego, Calif., USA) (F' mcrA ≅(mrr-hsdRMS-mcrBC) ≅80lacZ☐M15 ≅lacX74 deoR recA1 araD139 ≅(ara/leu)7697 galU galK rpsL (Str$^R$) endA1 nupG).

Media

Synthetic dextrose media (SD), containing 2% glucose, 1.34% Yeast Nitrogen Base without amino acids and 0.77 g/l CSM-ura (Bio 101, Vista, Calif., USA) was used to grow the *Candida albicans* transformants. In case of the wild type (CAI4), the media was supplemented with 50 μg/ml uridine.

To prepare plates the media was solidified with 2% agar. Expression of the synthetic BAX gene was performed using 2% galactose as carbon source.

Construction of the Codon-Optimised BAX Gene

Construction of the synthetic BAX gene followed the nomenclature described for *Candida albicans* (Lloyd and Sharp 1992; Brown, et al. 1991; http://alces.med.umn.edu/candida.html; http://www.kazusa.or.jp/codon). To ensure a high expression of the synthetic gene, the subset of 'optimal' codons of highly expressed genes was used to design the synthetic BAX gene.

The synthCaBAX gene was constructed in three parts using eight oligonucleotides (FIG. 5). The sequences of the oligonucleotides are given in Table 7. Primer A1 introduced upstream of the ATG codon a Pst I site and a Bgl II site. The Pst I site was used later on for direct cloning into the *Candida albicans* expression vector, while the Bgl II site served as a linker for a yEGFP fusion. Primer C2 introduced a Sma I site, suitable for cloning into the expression vector.

Fragment A and B were synthesised in two steps: in a first PCR round primer X1 and X2 (X represents A or B, respectively) were used together. The resulting fragment served as a template in a second PCR round together with primers X1 and X3. Fragment C was synthesised in a single PCR round using the primers C1 and C2. Fragment A and B were cloned into the pCR-BluntII-TOPO vector (Stratagene), while fragment C was cloned into the pCR2.1-TOPO vector (Stratagene). All three fragments were sequenced to ensure that no mutation was introduced by the PCR.

Subsequently, fragment A was digested with Pst I and Taq I, fragment B wit Taq I and Bam HI and fragment C with Bam HI and Sma I. The three products were cloned in a quadruple ligation into pUC21 digested with Pst I and Sma I resulting in the plasmid pUC21:synthCandidaBAX. The sequence of the synthetic BAX gene is shown in FIG. 6.

Construction of Synthetic BAX- and GFP-Synthetic BAX Expression Plasmids

A Pst I-Sma I fragment containing the ORF of the synthetic BAX gene was cloned into the Pst I-Stu I digested vector pGAL1ACT1LUC (W. Martinet, EP application nr 99204557.5) resulting in the expression construct pGAL1P:synthCaBAX (FIG. 7A). To facilitate recognition of the AUG codon during formation of initiation complexes a purine base (A) was introduced at position −3 from the AUG codon (Kozak 1981) using the Quick change site directed mutagenesis kit from Stratagene.

The yeast enhanced GFP gene yEGFP; (Cormack et al. 1997) was amplified by PCR using primer 5'-AACTGCAGATGTCTAAAGGTGAAGMTTATTC-3' (SEQ ID NO 11) as upstream primer and primer 5'-GGAAGATCTTCCTTTGTACAATTCATCC ATACC-3' (SEQ ID NO 12) as downstream primer. The sense primer introduced a Pst I site (shown in bold and italic), while the anti-sense primer contained a Bgl II linker (shown in bold and italic) for fusion with the synthetic BAX gene. After cloning of the yEGFP gene into the pCR2.1-TOPO vector (Stratagene), the gene was sequenced to ensure that no mutation was introduced by PCR.

The yEGFP-synth *Candida* BAX fusion was created by cloning a PstI-BglII yEGFP fragment together with a Bgl II-Sma I synthetic *Candida* BAX fragment into the Pst I-Stu I digested expression vector pGAL1 ACT1LUC. The obtained pGAL1 P:yEGFP-synthCaBAX fusion construct (FIG. 7B) was sequenced to ensure that no frameshift had occurred.

Creation of the Synthetic BAX Expression Strains

Transformation of the expression plasmids was performed using a modified procedure (Logghe, unpublished) of the spheroblasting protocol (Herreros et al. 1992). The plasmids were linearised with Bpu1102 I to allow directed integration into the genome at the GAL1 promoter site. Correct integration was analysed by Southern blotting. Therefore genomic DNA from different transformants was prepared using the Nucleon® extraction and purification kit (Amersham Pharmacia Biotech) and digested with Xba I. The BAX probe used in the Southern blot was prepared by PCR. The PCR was performed using the pGAL1P:synthCaBAX plasmid as template, together with the sense primer 5'-ATGGATGGTTCTGGTGMC-3' (SEQ ID NO 13) and the anti-sense primer 5'-TTAACCCATTTTTTTCCAGATG-3' (SEQ ID NO 14). Standard PCR conditions were used. For detection of the yEGFP a probe was synthesised by PCR using primer 5'-AGAGATCTCGAGGGATCC-3' (SEQ ID NO 15) as sense primer and primer 5'-GCATTATTTGTACMTTCATCC-3' (SEQ ID NO 16) as anti-sense primer. Southern blot hybridisation and detection were performed using the AlkPhos DIRECT labelling and detection system (Amersham Pharmacia Biotech) following the instructions of the manufacturer.

Western Blot Analysis

For Western blot analysis cells were pre-grown over night in SD-ura media till late log phase. The cells were harvested by centrifugation, washed twice with water and inoculated in SG-ura to induce Bax expression. Induction was performed for 15 hours. Yeast crude extracts were prepared as described before (Sambook, Fritsch et al. 1989). Detection of the Bax protein was performed using a polyclonal rabbit anti-mouse/rat Bax antibody (Pharmingen). Due to contamination of this antibody with yeast cell wall mannan antibodies, a very high background occurred. This problem could be avoided by pre-incubation of the antibody with 0.5 mg/ml purified yeast mannan (Rossanese et al. 1999). Detection of the Gfp protein was done using an anti-Gfp monoclonal antibody (Molecular Probes, Eugene, Oreg., USA).

Growth Curves

For growth curves, yeast cells were grown for 24 h in SD-ura medium (supplemented with uridine for the wild type). These cultures were harvested, washed twice with water and inoculated to an $OD_{600}$ of 0.1 into fresh SD-ura or SG-ura media. Growth was monitored in microtitre plates using the Bioscreen C system (Labsystems).

Viability Tests

Cells were pregrown in minimal dextrose medium to an $OD_{600}$ of 1. After washing the cells twice with water they were switched to minimal medium containing galactose as carbon source. At the time points indicated, samples were taken and equal cell amounts were spread on minimal dextrose plates. The appearing colonies represent the viable fraction of the pool.

Results: Conditional Expression of the Synthetic BAX Gene in Candida albicans

A cDNA encoding the full-length mouse Bax protein was placed under control of the Candida albicans GAL1 promoter allowing for conditional expression when cells are grown in galactose containing media. Initial experiments were performed using the wild type mouse bax gene. Expression of this gene did not result in any detectable phenotype, no difference in growth compared to the wild type was observed when cells were grown on galactose containing media (data not shown). This could be due to the non-traditional codon strategy adopted by Candida albicans and related species. Analysis of the codons used in the mouse BAX gene revealed a for Candida albicans not optimal codon usage as found for highly expressed genes in this yeast. To ensure a high expression of the BAX gene a codon-adapted, synthetic version of the gene was created using the strategy described above. The synthetic BAX gene was fused to the yEGFP to allow screening for transformants with a high yEGFP-synthCaBAX expression level using FACS technology. The newly obtained plasmids pGAL1 P:synthCaBAX and pGAL1:GFP-synthCaBAX were transformed into the C. albicans CAI4 strain. Transformants were selected on uridine-fee minimal medium. About 25 transformants of each expression construct were chosen and streaked onto minimal dextrose medium (non-inducing conditions) as well as on minimal galactose medium (inducing conditions). After two days incubation at 30° C. all transformants did grow on the glucose containing media. When galactose was used as a sole carbon source, most of the transformants did not grow (FIG. 8). Southern blot analysis of the galactose negative transformants revealed that a copy of the synthCaBAX gene had been integrated into the endogenous copy of the GAL1 promoter. To study differences in growth, the transformants were grown over night in synthetic glucose containing medium. Subsequently, cells were washed with water and switched to fresh medium containing galactose as carbon source. While the wild type strain did grow well on galactose containing media no growth was observed for the Bax expressing transformants (FIGS. 9A and B). Western blot analysis of the synthCaBAX transformants showed accumulation of the Bax protein (15 hours Bax induction, FIG. 10). A similar result was observed when immunoblotting was performed with the GFP-synthCaBAX expressing strains. Here the fusion protein was detected at the expected molecular weight of about 45K under inducing conditions (galactose as carbon source). In addition to the fusion protein a band appeared at the molecular weight of about 20K. This corresponds to the molecular weight of the Gfp protein alone. Addition of a Gfp-expressing strain as a positive control to the western blot did confirm these results. Here the Gfp protein was detected at the same molecular weight as the unexpected band in the GFP-synthCaBAX expressing strain (FIG. 11). This is most probably due to a partly proteolytic degradation of the fusion protein. Analysis of the Gfp-fluorescence using FACS technology showed a high Gfp-fluorescence signal for the transformants expressing the fusion protein (FIG. 12). When cell viability was analysed, different results were obtained for the synthCaBAX strain and the GFP-synthCaBAX strain. The synthCaBAX strain showed quite a rapid decrease in the amount of colony forming units during the first 6 hours of incubation on galactose containing media. Afterwards the process slowed down significantly. This is in contrast to the results obtained for the strain expressing the gfp-synthCabax fusion protein. Here almost all the cells died at a very rapid rate during the first 3 hours of incubation in media containing galactose as sole carbon source. It is possible that the Bax trigger in the synthCabax expressing cells is not strong enough to kill all cells. The cell has enough time to activate a sort of defence mechanism, possibly by proteolytic degradation of the Bax protein. The situation is different for the fusion protein. Gfp is a very stable protein itself. Fusion of the Gfp to another protein could result in a stabilisation of this protein. It would be more resistant to proteolytic degradation. This would explain the situation for the Gfp-Bax fusion. The Gfp-Bax protein is more protected from proteolytic degradation. Like that it is for a longer period present in the cell. The death trigger is herewith stronger, so the cells die faster. The time that the cells have to activate the proteolytic machinery is not sufficient for them to survive.

TABLE 1

| Oligo | Sequence 5' -> 3' |
|---|---|
| A1 | AACTGCAGGAAGATCTTCCATGGATGGTTCTGGTGAACAATTGGGTTCTGGTGG (SEQ ID NO 3) TCCAACCTCTTCTGAACAAATCATGAAAACCGGTGCTTTCTTGTTG |
| A2 | TAGAAGCATCTTGTGGTGGTTGTTCCAAGGTCAATTCTGGGGTTTCACCAGCC (SEQ ID NO 4) ATTCTACCAGCTCTATCTTGGATGAAACCTTGCAACAAGAAAGCACC |
| A3 | GGAATTCTCGACATCAGCGATCATTCTTTGCAATTCCATGTTAGAATCCAATTC (SEQ ID NO 5) ATCACCGATTCTTCTCAAACATTCAGACAATTTTTTGGTAGAAGCATCTTGTG |
| B1 | GGAATTCGCTGATGTCGATACCGATTCTCCAAGAGAAGTCTTCTTCAGAGTCG (SEQ ID NO 6) CTGCTGATATGTTCGCTGATGGTAACTTCAACTG |
| B2 | AATTCTGGGACTTTGGTACACAAAGCTTTCAAGACCAATTTAGAAGCGAAGTA (SEQ ID NO 7) GAACAAAGCGACGACTCTACCCCAGTTGAAGTTACCA |
| B3 | CCACCTTGATCTTGGATCCAGACCAACAATCTTTCTCTCAAGAAATCCAAGGTC (SEQ ID NO 8) CAACCCATGATGGTTCTGATCAATTCTGGGACTTTG |
| C1 | ATTGTTGGTCTGGATCCAAGATCAAGGTGGTTGGGAAGGTTTGTTGTCTTACTT (SEQ ID NO 9) CGGTACCCCAACCTGGCAAACCGTCA |
| C2 | TCCCCCGGGGGATTAACCCATTTTTTTCCAGATGGTCAAAGAAGCGGTCAAGAC (SEQ ID NO 10) ACCAGCGACGAAGATGGTGACGGTTTGCCAGGTTGGG |

TABLE 2

Overview of the differentially expressed genes after 30 min Bax expression
Comparison: INVSc1 YIpUTL versus INVSc1 YIpUTyLB

| ORF | Gene | Normalised intensities L | YLB | Up/down | Qt value |
|---|---|---|---|---|---|
| Cellular role: Cell cycle control | | | | | |
| YBR133C | HSL7 | 18932.54 | 37877.20 | ↑ | 2.00 |
| Cellular role: Polymerase II transcription | | | | | |
| YDR253C | MET32 | 17661.13 | 45567.17 | ↑ | 2.58 |
| YBR112C | SSN6 | 26698.87 | 65315.83 | ↑ | 2.45 |
| YDR145W | TAF61 | 38697.96 | 73117.62 | ↑ | 1.89 |
| YBR289W | SNF5 | 33111.77 | 72328.70 | ↑ | 2.18 |
| YDR216W | ADR1 | 30127.45 | 8815.87 | ↓ | 3.42 |
| YEL009C | GCN4 | 16533.76 | 3030.44 | ↓ | 5.46 |
| YBR089C-A | NHP6B | 22698.63 | 6297.49 | ↓ | 3.60 |
| YMR043W | MCM1 | 39141.64 | 84180.45 | ↑ | 2.15 |
| YKR092C | SRP40 | 5965.63 | 16105.82 | ↑ | 2.70 |
| YMR273C | ZDS1 | 14699.61 | 35508.04 | ↑ | 2.42 |
| YPL089C | RLM1 | 34922.91 | 67856.88 | ↑ | 1.94 |
| YOR372C | NDD1 | 20285.12 | 44445.20 | ↑ | 2.19 |
| YPL037C | EGD1 | 30633.33 | 5250.70 | ↓ | 5.83 |
| Cellular role: Cell polarity | | | | | |
| YBL085W | BOI1 | 7693.29 | 18614.99 | ↑ | 2.42 |
| Cellular role: Chromatine structure | | | | | |
| YBR009C | HHF1 | 16668.00 | 4178.80 | ↓ | 3.99 |
| YNL030W | HHF2 | 49878.04 | 12566.96 | ↓ | 3.97 |
| YDR224C | HTB1 | 67355.40 | 23156.82 | ↓ | 2.91 |
| YBL002W | HTB2 | 25269.02 | 5383.97 | ↓ | 4.69 |
| Cellular role: RNA processing | | | | | |
| YER112W | USS1 | 12776.74 | 31470.70 | ↑ | 2.46 |
| YPL190C | NAB3 | 6381.36 | 17892.11 | ↑ | 2.80 |
| YNL112W | DBP2 | 9956.84 | 28036.48 | ↑ | 2.82 |
| Cellular role: Energy generation | | | | | |
| YPL078C | ATP4 | 26902.69 | 5980.38 | ↓ | 4.50 |
| YDL004W | ATP16 | 36525.08 | 3004.34 | ↓ | 12.16 |
| YDR377W | ATP17 | 14419.41 | 756.86 | ↓ | 19.05 |
| YDR529C | QCR7 | 35346.95 | 5394.65 | ↓ | 6.55 |
| YGR008C | STF2 | 13275.51 | 2276.27 | ↓ | 5.83 |
| YEL039C | CYC7 | 13604.38 | 2689.66 | ↓ | 5.06 |
| YKL150W | MCR1 | 105337.67 | 30743.75 | ↓ | 3.43 |
| YLR038C | COX12 | 52687.73 | 5455.83 | ↓ | 9.66 |
| YLR327C | | 113.966.77 | 54.014.65 | ↓ | 2.11 |
| Cellular role: Carbohydrate metabolism | | | | | |
| YBR149W | ARA1 | 15149.55 | 4095.17 | ↓ | 3.70 |
| YHR094C | HXT1 | 12526.90 | 785.73 | ↓ | 15.94 |
| YDR345C | HXT3 | 36643.13 | 1632.48 | ↓ | 22.45 |
| YDR343C | HXT6 | 77064.71 | 32060.05 | ↓ | 2.40 |
| YDR342C | HXT7 | 76349.13 | 27615.15 | ↓ | 2.76 |
| Cellular role: Signal transduction | | | | | |
| YER177W | BMH1 | 22856.29 | 44771.71 | ↑ | 1.96 |
| YDR099W | BMH2 | 40127.38 | 74572.38 | ↑ | 1.86 |
| YGR070W | ROM1 | 12055.28 | 28169.57 | ↑ | 2.34 |
| YGR023W | MTL1 | 7354.78 | 19648.06 | ↑ | 2.67 |
| Cellular role: Protein synthesis | | | | | |
| YGR034W | RPL26B | 71942.48 | 74625.22 | ↑ | 1.04 |
| Cellular role: Protein folding | | | | | |
| YLR216C | CPR6 | 9616.80 | 31126.02 | ↑ | 3.24 |
| Cellular role: Protein modification/degradation | | | | | |
| YFR052W | RPN12 | 5583.57 | 14855.67 | ↑ | 2.66 |
| YDL147W | RPN5 | 31932.20 | 52939.11 | ↑ | 1.66 |
| YGR132C | PHB1 | 15429.56 | 5591.19 | ↓ | 2.76 |
| YGR135W | PRE9 | 39921.63 | 5517.17 | ↓ | 7.24 |
| YFR010W | UBP6 | 1892.76 | 828.94 | ↓ | 2.28 |
| Cellular role: Cell stress | | | | | |
| YIR037W | GPX3 | 7869.22 | 21789.00 | ↑ | 2.77 |
| YDR513W | TTR1 | 55986.32 | 33263.12 | ↓ | 1.68 |
| YCL035C | GRX1 | 70248.30 | 10969.97 | ↓ | 6.40 |
| YFL014W | HSP12 | 41689.29 | 18658.48 | ↓ | 2.23 |
| YHR053C | CUP1A | 72852.07 | 43488.52 | ↓ | 1.68 |
| YHR055C | CUP1B | 71934.03 | 56799.80 | ↓ | 2.77 |
| YMR173W | DDR48 | 16670.70 | 5022.40 | ↓ | 3.32 |

TABLE 2-continued

Overview of the differentially expressed genes after 30 min Bax expression
Comparison: INVSc1 YIpUTL versus INVSc1 YIpUTyLB

| ORF | Gene | Normalised intensities L | YLB | Up/down | Qt value |
|---|---|---|---|---|---|
| YMR251W-A | HOR7 | 26879.95 | 417.36 | ↓ | 64.41 |
| YLR043C | TRX1 | 58251.39 | 4435.79 | ↓ | 13.13 |
| YBL064C | PRX1 | 21525.00 | 40969.00 | ↑ | 1.90 |
| YOL151W | GRE2 | 2624.55 | 24152.03 | ↑ | 9.20 |
| *Cellular role: Unknown* | | | | | |
| YBL081W | | 73834.11 | 74612.35 | ↑ | 1.01 |
| YDR366C | | 39998.46 | 57428.80 | ↑ | 1.44 |
| YCR004C | YCP4 | 6869.06 | 28115.73 | ↑ | 4.09 |
| YCR013C | | 3988.55 | 15144.34 | ↑ | 3.80 |
| YBR050C | REG2 | 4687.91 | 14408.20 | ↑ | 3.07 |
| YBL109W | | 18744.60 | 35440.24 | ↑ | 1.89 |
| YDR154C | | 19565.23 | 69428.03 | ↑ | 3.55 |
| YEL071W | DLD3 | 22235.73 | 68790.83 | ↑ | 3.09 |
| YHR095W | | 14426.76 | 34896.68 | ↑ | 2.42 |
| YGR069W | | 43413.57 | 72420.39 | ↑ | 1.67 |
| YDR544C | | 13567.00 | 27004.37 | ↑ | 1.99 |
| YGR236C | | 24927.59 | 8032.35 | ↓ | 3.10 |
| YIL057C | | 24246.39 | 773.56 | ↓ | 31.34 |
| YGL080W | | 23425.00 | 3217.81 | ↓ | 7.28 |
| YGL072C | | 16437.52 | 2652.80 | ↓ | 6.20 |
| YHR056C | RSC30 | 72072.88 | 57446.85 | ↓ | 1.25 |
| YKL054C | VID31 | 17990.49 | 38258.80 | ↑ | 2.13 |
| YLR311C | | 7992.40 | 24164.87 | ↑ | 3.02 |
| YJR115W | | 64690.69 | 102066.34 | ↑ | 1.58 |
| YJL188C | BUD19 | 7580.28 | 22325.70 | ↑ | 2.95 |
| YKR040C | | 50934.78 | 100733.41 | ↑ | 1.98 |
| YLR053C | | 8117.66 | 20317.34 | ↑ | 2.50 |
| YOR121C | | 59950.94 | 92470.43 | ↑ | 1.54 |
| YNL143C | | 98911.28 | 110534.34 | ↑ | 1.12 |
| YOR131C | | 7941.55 | 22353.72 | ↑ | 2.81 |
| YNL338W | | 21800.45 | 38777.28 | ↑ | 1.78 |
| YNL179C | | 13729.36 | 39516.53 | ↑ | 2.88 |
| YOL150C | | 3408.74 | 60298.39 | ↑ | 17.69 |
| YMR107W | | 65118.70 | 10042.46 | ↓ | 6.48 |
| YKL065W | YET1 | 69556.19 | 12804.88 | ↓ | 5.43 |
| YJR096W | | 21780.37 | 10655.13 | ↓ | 2.04 |
| YJL161W | | 16468.73 | 2618.26 | ↓ | 6.29 |
| YML128C | MSC1 | 80130.20 | 13795.84 | ↓ | 5.81 |
| YMR251W | | 26879.95 | 417.36 | ↓ | 64.41 |
| YMR173W-A | | 110104.98 | 61951.23 | ↓ | 1.78 |
| YPL201C | | 17913.32 | 5018.97 | ↓ | 3.57 |
| YOR285W | | 64074.73 | 29749.43 | ↓ | 2.15 |
| YOR286W | | 13458.08 | 733.06 | ↓ | 18.36 |
| *Cellular role: Cell wall maintenance* | | | | | |
| YKR076W | ECM4 | 2674.15 | 13040.04 | ↑ | 4.88 |
| YLR390W | ECM19 | 5472.05 | 15145.85 | ↑ | 2.77 |
| *Cellular role: Membrane fusion* | | | | | |
| YHR138C | | 19921.35 | 3707.57 | ↓ | 5.37 |
| *Cellular role: Vesicular transport* | | | | | |
| YHR161C | YAP180A | 13086.35 | 30160.90 | ↑ | 2.30 |
| YPL085W | SEC16 | 6668.57 | 15206.49 | ↑ | 2.28 |
| YKL196C | YKT6 | 18933.84 | 2890.07 | ↓ | 6.55 |
| YPR028W | YIP2 | 25434.34 | 2049.47 | ↓ | 12.41 |
| *Cellular role: DNA repair/recombination* | | | | | |
| YDL059C | RAD59 | 1948.61 | 13089.13 | ↑ | 6.72 |
| *Cellular role: DNA synthesis* | | | | | |
| YEL032W | MCM3 | 23422.85 | 44327.48 | ↑ | 1.89 |
| *Cellular role: Amino acid metabolism* | | | | | |
| YIL074C | SER33 | 3978.42 | 16702.66 | ↑ | 4.20 |
| YGR155W | CYS4 | 4184.59 | 19270.89 | ↑ | 4.61 |

TABLE 2-continued

Overview of the differentially expressed genes after 30 min Bax expression
Comparison: INVSc1 YIpUTL versus INVSc1 YIpUTyLB

| ORF | Gene | Normalised intensities L | YLB | Up/down | Qt value |
|---|---|---|---|---|---|
| *Cellular role: Fatty acid metabolism* | | | | | |
| YHR179W | OYE2 | 2291.36 | 40274.02 | ↑ | 17.58 |
| *Cellular role: Protein translocation* | | | | | |
| YNL131W | TOM22 | 16287.21 | 1679.78 | ↓ | 9.70 |
| *Cellular role: Small molecule transport* | | | | | |
| YDR276C | SNA1 | 21148.46 | 1580.68 | ↓ | 13.38 |
| YOR267C | HRK1 | 62689.30 | 110516.24 | ↑ | 1.76 |
| YHR039-C | VMA10 | 60107.90 | 8490.93 | ↓ | 7.08 |
| YOR382W | FIT2 | 6780.82 | 27236.15 | ↑ | 4.02 |

TABLE 3

Overview of the differentially expressed genes after 1 h Bax expression
Comparison: INVSc1 YIpUTL versus INVSc1 YIpUTyLB

| ORF | Gene | Normalised intensities L | YLB | Up/down | Qt value |
|---|---|---|---|---|---|
| *Cellular role: Polymerase II transcription* | | | | | |
| YDR145W | TAF61 | 20729.58 | 57376.27 | ↑ | 2.77 |
| YDR216W | ADR1 | 5925.91 | 18459.00 | ↑ | 3.11 |
| YBR112C | CYC8 | 50186.77 | 64511.50 | ↑ | 1.29 |
| YMR043W | MCM1 | 21011.54 | 53700.49 | ↑ | 2.56 |
| YPL089C | RLM1 | 23440.54 | 64284.32 | ↑ | 2.74 |
| YOR372C | NDD1 | 26412.58 | 50804.99 | ↑ | 1.92 |
| *Cellular role: Cell cycle control* | | | | | |
| YBR133C | HSL7 | 18761.64 | 53238.86 | ↑ | 2.84 |
| *Cellular role: Cell polarity* | | | | | |
| YBL085W | BOI1 | 37895.40 | 57761.52 | ↑ | 1.52 |
| *Cellular role: Chromatine structure* | | | | | |
| YDR224C | HTB1 | 13661.40 | 55656.34 | ↑ | 4.07 |
| *Cellular role: Energy generation* | | | | | |
| YGR183C | QCR9 | 23181.54 | 81865.40 | ↑ | 3.53 |
| YLR294C | | 5054.57 | 28994.72 | ↑ | 5.74 |
| YKL150W | MCR1 | 43663.07 | 60593.16 | ↑ | 1.39 |
| YMR256C | COX7 | 7606.58 | 28801.54 | ↑ | 3.79 |
| YOL126C | MDH2 | 34144.61 | 65326.97 | ↑ | 1.91 |
| YLR327C | | 97415.94 | 101651.17 | ↑ | 1.04 |
| *Cellular role: Vesicular transport* | | | | | |
| YHR161C | YAP180A | 11602.81 | 34695.20 | ↑ | 2.99 |
| YLR206W | ENT2 | 14439.24 | 34621.70 | ↑ | 2.40 |
| *Cellular role: Carbohydrate metabolism* | | | | | |
| YDR342C | HXT7 | 65273.56 | 22231.06 | ↓ | 2.94 |
| YDR343C | HXT6 | 43572.28 | 6075.38 | ↓ | 7.17 |
| YDR345C | HXT3 | 76352.52 | 40296.00 | ↓ | 1.89 |
| YGR192C | TDH3 | 38472.30 | 14145.84 | ↓ | 2.72 |
| YKR097W | PCK1 | 22919.81 | 38225.98 | ↑ | 1.67 |
| YOR374W | ALD4 | 33711.37 | 2607.43 | ↓ | 12.93 |
| *Cellular role: Signal transduction* | | | | | |
| YER177W | BMH1 | 16298.14 | 31748.91 | ↑ | 1.95 |
| YDR099W | BMH2 | 50572.45 | 65123.58 | ↑ | 1.29 |
| *Cellular role: Cell wall maintenance* | | | | | |
| YLR110C | CCW12 | 102525.29 | 11230.41 | ↓ | 9.13 |

TABLE 3-continued

Overview of the differentially expressed genes after
1 h Bax expression
Comparison: INVSc1 YIpUTL versus INVSc1 YIpUTyLB

| | | Normalised intensities | | Up/ | Qt |
|---|---|---|---|---|---|
| ORF | Gene | L | YLB | down | value |
| Cellular role: Protein modification/degradation | | | | | |
| YOR261C | RPN8 | 12575.49 | 32568.47 | ↑ | 2.59 |
| Cellular role: Cell stress | | | | | |
| YHR053C | CUP1A | 32531.53 | 63579.94 | ↑ | 1.95 |
| YHR055C | CUP1B | 27939.92 | 65142.82 | ↑ | 2.33 |
| YMR173W | DDR48 | 38338.83 | 60514.70 | ↑ | 1.58 |
| YOR031W | CRS5 | 2922.32 | 23848.60 | ↑ | 8.16 |
| YLR109W | AHP1 | 43067.08 | 6302.46 | ↓ | 6.83 |
| Cellular role: Unknown | | | | | |
| YBL081W | | 82476.13 | 44279.86 | ↑ | 1.86 |
| YBL109W | | 22998.63 | 63428.23 | ↑ | 2.76 |
| YDR366C | | 14599.17 | 46494.73 | ↑ | 3.18 |
| YDR154C | | 21296.57 | 56534.93 | ↑ | 2.65 |
| YGR236C | SPG1 | 17717.80 | 64439.96 | ↑ | 3.64 |
| YHR056C | RSC30 | 27020.16 | 65110.42 | ↑ | 2.41 |
| YGR182C | | 8171.02 | 34669.96 | ↑ | 4.24 |
| YDR544C | | 14797.70 | 37704.91 | ↑ | 2.55 |
| YHR162W | | 13836.79 | 33381.64 | ↑ | 2.41 |
| YGR243W | | 30829.66 | 59765.39 | ↑ | 1.94 |
| YBR050C | REG2 | 14008.24 | 29603.16 | ↑ | 2.11 |
| YEL071W | DLD3 | 19487.41 | 35273.39 | ↑ | 1.81 |
| YDR133C | | 83074.54 | 62986.96 | ↓ | 1.32 |
| YDR134C | | 83111.03 | 16839.53 | ↓ | 4.94 |
| YHL021C | | 46028.06 | 8577.00 | ↓ | 5.37 |
| YKL054C | VID31 | 28018.46 | 66537.91 | ↑ | 2.37 |
| YLR311C | | 7803.52 | 31160.73 | ↑ | 3.99 |
| YMR107W | | 13453.15 | 78850.98 | ↑ | 5.86 |
| YKL066W | | 8751.84 | 24129.32 | ↑ | 2.76 |
| YMR173W-A | | 38338.83 | 60514.70 | ↑ | 1.58 |
| YML053C | | 23670.86 | 66254.48 | ↑ | 2.80 |
| YOR121C | | 17039.58 | 58016.58 | ↑ | 3.40 |
| YOL106W | | 19917.67 | 69853.66 | ↑ | 3.51 |
| YNL338W | | 17864.90 | 49911.08 | ↑ | 2.79 |
| YJR115W | | 84858.02 | 98161.71 | ↑ | 1.16 |
| Cellular role: Small molecule transport | | | | | |
| YOR267C | HRK1 | 90123.84 | 96824.51 | ↑ | 1.07 |

TABLE 4

Overview of the differentially expressed genes after
2 h Bax expression
Comparison: INVSc1 YIpUTL versus INVSc1 YIpUTyLB

| | | Normalised intensities | | Up/ | Qt |
|---|---|---|---|---|---|
| ORF | Gene | L | YLB | Down | value |
| Cellular role: Protein modification/degradation | | | | | |
| YCL052C | PBN1 | 5264.22 | 8175.70 | ↑ | 1.55 |
| YDL147W | RPN5 | 22386.40 | 47857.67 | ↑ | 2.14 |
| YOR261C | RPN8 | 27349.25 | 42198.05 | ↑ | 1.54 |
| YGR132C | PHB1 | 5252.03 | 8459.53 | ↑ | 1.61 |
| YBR139W | | 9458.26 | 3611.21 | ↓ | 2.62 |
| Cellular role: Unknown | | | | | |
| YDR202C | RAV2 | 7483.71 | 10089.19 | ↑ | 1.35 |
| YBR062C | | 4893.97 | 9894.82 | ↑ | 2.02 |
| YDR366C | | 25468.2 | 59682.92 | ↑ | 2.34 |
| YBL109W | | 24803.62 | 37444.64 | ↑ | 1.51 |
| YDR154C | | 21166.26 | 33434.35 | ↑ | 1.58 |
| YEL071W | DLD3 | 34153.85 | 44083.39 | ↑ | 1.29 |
| YGR236C | SPG1 | 16978.52 | 31419.12 | ↑ | 1.85 |
| YGR182C | | 30569.31 | 58805.05 | ↑ | 1.92 |

TABLE 4-continued

Overview of the differentially expressed genes after
2 h Bax expression
Comparison: INVSc1 YIpUTL versus INVSc1 YIpUTyLB

| | | Normalised intensities | | Up/ | Qt |
|---|---|---|---|---|---|
| ORF | Gene | L | YLB | Down | value |
| YDR544C | | 15937.14 | 24421.99 | ↑ | 1.53 |
| YHR162W | | 26610.34 | 33794.73 | ↑ | 1.27 |
| YHR056C | RSC30 | 33372.66 | 68425.24 | ↑ | 2.05 |
| YDR133C | | 75520.99 | 62984.59 | ↓ | 1.20 |
| YCR010C | ADY2 | 17240.59 | 11835.82 | ↓ | 1.46 |
| YDR134C | | 72723.66 | 9776.23 | ↓ | 7.44 |
| YGR069W | | 65418.73 | 53767.35 | ↓ | 1.22 |
| YIL057C | | 16510.16 | 2198.04 | ↓ | 7.51 |
| YGL072C | | 12209.68 | 6509.91 | ↓ | 1.88 |
| YGL080W | | 22550.76 | 11525.24 | ↓ | 1.96 |
| YLR311C | | 11095.31 | 24660.47 | ↑ | 2.22 |
| YJR115W | | 74757.70 | 103422.48 | ↑ | 1.38 |
| YMR099C | | 7057.15 | 11477.42 | ↑ | 1.63 |
| YMR173W-A | | 31901.05 | 48886.91 | ↑ | 1.47 |
| YML132W | COS3 | 24648.97 | 34895.33 | ↑ | 1.42 |
| YKL066W | | 13581.94 | 25433.97 | ↑ | 1.87 |
| YJL142C | | 7205.86 | 11920.21 | ↑ | 1.65 |
| YLR346C | | 6447.57 | 11569.63 | ↑ | 1.79 |
| YLR053C | | 41161.10 | 78636.82 | ↑ | 1.91 |
| YMR110C | | 19410.64 | 29661.23 | ↑ | 1.53 |
| YKR075C | | 19104.57 | 29948.72 | ↑ | 1.57 |
| YOR121C | | 36492.56 | 59452.09 | ↑ | 1.63 |
| Cellular role: Unknown | | | | | |
| YOL106W | | 31382.10 | 76664.72 | ↑ | 2.44 |
| YNL338W | | 24117.93 | 38981.22 | ↑ | 1.62 |
| YNL134C | | 9617.33 | 14613.60 | ↑ | 1.52 |
| YKL065C | YET1 | 52422.65 | 33794.03 | ↓ | 1.55 |
| YMR009W | | 20666.22 | 9519.29 | ↓ | 2.17 |
| YJL144W | | 10316.92 | 3122.77 | ↓ | 3.30 |
| YML128C | MSC1 | 584128.13 | 25434.11 | ↓ | 2.29 |
| YNL179C | | 21938.96 | 10883.98 | ↓ | 2.02 |
| YOL109W | ZEO1 | 22711.98 | 6581.11 | ↓ | 3.45 |
| YNR002C | FUN34 | 18241.25 | 9752.25 | ↓ | 1.87 |
| Cellular role: Chromatine structure | | | | | |
| YDR224C | HTB1 | 25356.73 | 30827.54 | ↑ | 1.22 |
| YBL002W | HTB2 | 9241.68 | 14261.54 | ↑ | 1.54 |
| YBL003C | HTA2 | 3453.55 | 6553.49 | ↑ | 1.90 |
| YNL031C | HHT2 | 13376.02 | 2348.84 | ↓ | 5.69 |
| Cellular role: Polymerase II transcription | | | | | |
| YBR289W | SNF5 | 59542.27 | 65885.13 | ↑ | 1.11 |
| YDR073W | SNF11 | 12190.01 | 23088.03 | ↑ | 1.89 |
| YMR043W | MCM1 | 66457.16 | 77022.05 | ↑ | 1.16 |
| YPL089C | RLM1 | 49844.99 | 60624.28 | ↑ | 1.22 |
| Cellular role: Signal transduction | | | | | |
| YDR099W | BMH2 | 55902.13 | 73874.51 | ↑ | 1.32 |
| Cellular role: Cell stress | | | | | |
| YBL064C | PRX1 | 11203.87 | 14815.42 | ↑ | 1.32 |
| YBR101C | | 25016.27 | 35781.64 | ↑ | 1.43 |
| YLR043C | TRX1 | 10864.53 | 3912.03 | ↓ | 2.78 |
| YGR209C | TRX2 | 30492.33 | 37829.20 | ↑ | 1.24 |
| YER103W | SSA4 | 8763.38 | 15799.18 | ↑ | 1.80 |
| YHR055C | CUP1B | 18824.43 | 77613.05 | ↑ | 4.12 |
| YHR053C | CUP1A | 32726.62 | 63536.72 | ↑ | 1.94 |
| YDR256C | CTA1 | 9614.29 | 4232.17 | ↓ | 2.27 |
| YCR021C | HSP30 | 8090.05 | 3604.78 | ↓ | 2.24 |
| YCL035C | GRX1 | 28437.57 | 12843.99 | ↓ | 2.21 |
| YGR086C | | 36796.12 | 24272.57 | ↓ | 1.52 |
| YFL014W | HSP12 | 61868.64 | 23288.19 | ↓ | 2.66 |
| YOR031W | CRS5 | 6015.69 | 14519.12 | ↑ | 2.41 |
| YMR251W-A | HOR7 | 17731.14 | 4231.39 | ↓ | 4.19 |
| YOR120W | GCY1 | 114252.98 | 78052.05 | ↓ | 1.46 |
| Cellular role: Protein synthesis | | | | | |
| YAL003W | EFB1 | 3044.80 | 5772.68 | ↑ | 1.90 |
| YOL127W | RPL25 | 6266.96 | 12055.41 | ↑ | 1.92 |
| YHR010W | RPL27 | 4057.16 | 10856.34 | ↑ | 2.68 |

TABLE 4-continued

Overview of the differentially expressed genes after
2 h Bax expression
Comparison: INVSc1 YIpUTL versus INVSc1 YIpUTyLB

| ORF | Gene | Normalised intensities L | YLB | Up/Down | Qt value |
|---|---|---|---|---|---|
| YLR325C | RPL38 | 5401.85 | 12955.89 | ↑ | 2.40 |
| YJL189W | RPL39 | 2044.64 | 8010.67 | ↑ | 3.92 |
| YIL148W | RPL40A | 5052.35 | 11595.54 | ↑ | 2.30 |
| YKR094C | RPL40B | 3994.57 | 10011.13 | ↑ | 2.54 |
| YOL139C | CDC33 | 4132.18 | 8956.14 | ↑ | 2.17 |
| Cellular role: Protein folding | | | | | |
| YLR216C | CPR6 | 20353.43 | 32713.37 | ↑ | 1.61 |
| YKL117W | SBA1 | 11144.25 | 1500.56 | ↓ | 7.43 |
| Cellular role: Vesicular transport | | | | | |
| YCR009C | RVS161 | 5350.32 | 9780.92 | ↑ | 1.83 |
| YHR161C | YAP180A | 25136.63 | 32461.67 | ↑ | 1.29 |
| YBL078C | AUT7 | 16528.91 | 9843.25 | ↓ | 1.68 |
| Cellular role: Carbohydrate metabolism | | | | | |
| YBL058W | SHP1 | 4626.50 | 8179.94 | ↑ | 1.77 |
| YBR149W | ARA1 | 30706.41 | 9637.76 | ↓ | 3.19 |
| YDR178W | SDH4 | 14880.91 | 6237.35 | ↓ | 2.39 |
| YHR094C | HXT1 | 30389.99 | 18383.00 | ↓ | 1.65 |
| YMR011W | HXT2 | 39524.90 | 21221.96 | ↓ | 1.86 |
| YDR345C | HXT3 | 77025.40 | 56749.40 | ↓ | 1.36 |
| YDR343C | HXT6 | 73149.70 | 8676.17 | ↓ | 8.43 |
| YDR342C | HXT7 | 75331.76 | 27052.43 | ↓ | 2.78 |
| YKL060C | FBA1 | 16273.54 | 21323.23 | ↑ | 1.31 |
| Cellular role: Cell cycle control | | | | | |
| YBR133C | HSL7 | 32903 | 41964.32 | ↑ | 1.28 |
| Cellular role: Energy generation | | | | | |
| YMR256C | COX7 | 18558.01 | 40422.91 | ↑ | 2.18 |
| YML129C | COX14 | 11418.54 | 21798.88 | ↑ | 1.91 |
| YFR033C | QCR6 | 9159.48 | 13398.67 | ↑ | 1.46 |
| YDR529C | QCR7 | 24821.75 | 16556.87 | ↓ | 1.50 |
| YJL166W | QCR8 | 15554.30 | 24509.26 | ↑ | 1.58 |
| YHR001W-A | QCR10 | 12416.35 | 23465.31 | ↑ | 1.89 |
| YBR039W | ATP3 | 11709.79 | 3088.19 | ↓ | 3.79 |
| YPL078C | ATP4 | 11325.64 | 13769.72 | ↑ | 1.22 |
| YPL271W | ATP15 | 3261.75 | 7839.05 | ↑ | 2.40 |
| YLR327C | | 51742.90 | 128511.27 | ↑ | 2.48 |
| YLR294C | | 15832.61 | 38544.44 | ↑ | 2.43 |
| YAL060W | FUN49 | 11792.72 | 5778.91 | ↓ | 2.04 |
| Cellular role: Small molecule transport | | | | | |
| YDR276C | SNA1 | 19337.39 | 12392.29 | ↓ | 1.56 |
| YGR197C | SNG1 | 4766.18 | 10484.09 | ↑ | 2.20 |
| YHR039C-B | VMA10 | 21190.93 | 10592.98 | ↓ | 2.00 |
| YOR267C | HRK1 | 111849.17 | 101339.10 | ↓ | 1.10 |
| Cellular role: RNA processing | | | | | |
| YGR250C | | 8709.92 | 17358.43 | ↑ | 1.99 |
| Cellular role: Cell wall maintenance | | | | | |
| YER150W | SPI1 | 55592.73 | 22403.59 | ↓ | 2.48 |
| YLR110C | CCW12 | 35147.41 | 5786.88 | ↓ | 6.07 |
| Cellular role: Cell polarity | | | | | |
| YOR122C | PFY1 | 14459.45 | 20176.41 | ↑ | 1.40 |
| Cellular role: Amino acid metabolism | | | | | |
| YPR035W | GLN1 | 20894.14 | 7522.05 | ↓ | 2.78 |

TABLE 5

Overview of the differentially expressed genes
after 3 h Bax expression
Comparison: INVSc1 YIpUTL versus INVSc1 YIpUTyLB

| ORF | Gene | Normalised intensities L | YLB | Up/down | Qt value |
|---|---|---|---|---|---|
| Cellular role: Cell cycle control | | | | | |
| YBR133C | HSL7 | 63562.10 | 43191.28 | ↓ | 1.47 |
| Cellular role: Cell polarity | | | | | |
| YBL085W | BOI1 | 32734.79 | 23497.41 | ↓ | 1.39 |
| Cellular role: Chromatine structure | | | | | |
| YDR545W | YRF1-1 | 20111.51 | 11479.67 | ↓ | 1.75 |
| Cellular role: Energy generation | | | | | |
| YCR005C | CIT2 | 11882.42 | 25632.94 | ↑ | 2.16 |
| YGR183C | QCR9 | 74474.20 | 11510.99 | ↓ | 6.47 |
| YOL126C | MDH2 | 55984.88 | 17978.10 | ↓ | 3.11 |
| Cellular role: Carbohydrate metabolism | | | | | |
| YBR019C | GAL10 | 3092.50 | 15697.54 | ↑ | 5.08 |
| YDR345C | HXT3 | 14086.41 | 25657.66 | ↑ | 1.82 |
| YKR097W | PCK1 | 50736.44 | 20858.02 | ↓ | 2.43 |
| Cellular role: Signal transduction | | | | | |
| YDR099W | BMH2 | 63285.16 | 56028.91 | ↓ | 1.13 |
| Cellular role: Protein synthesis | | | | | |
| YHR010W | RPL27A | 23254.90 | 7217.14 | ↓ | 3.22 |
| YLR325C | RPL38 | 26725.96 | 9121.29 | ↓ | 2.93 |
| Cellular role: Cell stress | | | | | |
| YFL014W | HSP12 | 40848.44 | 69781.91 | ↑ | 1.71 |
| YHR053C | CUP1A | 20399.10 | 65037.14 | ↑ | 3.19 |
| YHR055C | CUP1B | 21763.09 | 64594.58 | ↑ | 2.97 |
| YMR173W | DDR48 | 75407.16 | 36354.37 | ↓ | 2.07 |
| YOL052C-A | DDR2 | 20479.72 | 33702.23 | ↑ | 1.65 |
| Cellular role: Unknown | | | | | |
| YIL057C | | 7602.78 | 24104.02 | ↑ | 3.17 |
| YHR056C | RSC30 | 41473.41 | 64809.08 | ↑ | 1.56 |
| YDR544C | | 55075.67 | 29731.72 | ↓ | 1.85 |
| YKR040C | | 48049.71 | 59649.47 | ↑ | 1.24 |
| YNL338W | | 86107.91 | 30045.62 | ↓ | 2.87 |
| YJR115W | | 74889.58 | 81238.98 | ↓ | 1.08 |
| YBL109W | | 64754.79 | 57185.99 | ↓ | 1.13 |
| YMR173W-A | | 75407.16 | 36354?37 | ↓ | 2.07 |

TABLE 6

Overview of the differentially expressed genes
after 6 h Bax expression
Comparison: INVSc1 YIpUTL versus INVSc1 YIpUTyLB

| ORF | Gene | Normalised intensities L | YLB | Up/down | Qt value |
|---|---|---|---|---|---|
| Cellular role: Cell stress | | | | | |
| YDR171W | HSP42 | 13484.04 | 27183.07 | ↑ | 2.02 |
| YFL014W | HSP12 | 41497.12 | 29081.08 | ↓ | 1.42 |
| YDR513W | TTR1 | 19985.22 | 12935.62 | ↓ | 1.54 |
| YCL035C | GRX1 | 31735.39 | 12930.71 | ↓ | 2.45 |
| YGR209C | TRX2 | 54455.65 | 47569.21 | ↓ | 1.14 |
| YHR053C | CUP1A | 81488.84 | 15289.39 | ↓ | 5.33 |
| YHR055C | CUP1B | 81278.95 | 20031.69 | ↓ | 4.06 |
| YMR251W-A | HOR7 | 18824.54 | 5914.28 | ↓ | 3.18 |
| Cellular role: Signal transduction | | | | | |
| YDR099W | BMH2 | 29412.99 | 58598.42 | ↑ | 1.99 |

TABLE 6-continued

Overview of the differentially expressed genes after 6 h Bax expression
Comparison: INVSc1 YIpUTL versus INVSc1 YIpUTyLB

| ORF | Gene | Normalised intensities L | YLB | Up/down | Qt value |
|---|---|---|---|---|---|
| \multicolumn{6}{c}{Cellular role: Protein synthesis} ||||||
| YGL147C | RPL9A | 13655.66 | 1585.97 | ↓ | 8.61 |
| YGR085C | RPL11B | 27465.15 | 3791.35 | ↓ | 7.24 |
| YDR418W | RPL12B | 14417.77 | 1555.24 | ↓ | 9.27 |
| YLR029C | RPL15A | 37122.11 | 9321.81 | ↓ | 3.98 |
| YOR312C | RPL20B | 50334.94 | 5706.59 | ↓ | 8.82 |
| YBR191W | RPL21A | 21740.90 | 2571.30 | ↓ | 8.46 |
| YPL079W | RPL21B | 31059.43 | 5023.61 | ↓ | 6.18 |
| YOL127W | RPL25 | 75971.72 | 11749.17 | ↓ | 6.47 |
| YHR010W | RPL27A | 45716.64 | 8096.40 | ↓ | 5.65 |
| YDR471W | RPL27B | 14636.79 | 2613.40 | ↓ | 5.60 |
| YDL075W | RPL31A | 11969.47 | 2611.53 | ↓ | 4.58 |
| YBL092W | RPL32 | 7872.80 | 857.85 | ↓ | 9.18 |
| YDL191W | RPL35A | 28582.59 | 6046.25 | ↓ | 4.73 |
| YDL136W | RPL35B | 25433.49 | 5064.51 | ↓ | 5.02 |
| YLR325C | RPL38 | 48051.23 | 8217.18 | ↓ | 5.85 |
| YIL148W | RPL40A | 47028.95 | 9543.65 | ↓ | 4.93 |
| YKR094C | RPL40B | 39900.50 | 5957.78 | ↓ | 6.70 |
| YHR141C | RPL42B | 10163.88 | 937.21 | ↓ | 10.84 |
| YML063W | RPS1B | 15916.48 | 1144.54 | ↓ | 13.91 |
| YGL123W | RPS2 | 12505.56 | 2243.26 | ↓ | 5.57 |
| YOR096W | RPS7A | 24164.37 | 3223.60 | ↓ | 7.50 |
| YBL072C | RPS8A | 17198.50 | 3233.30 | ↓ | 5.32 |
| YER102W | RPS8B | 16234.83 | 1791.18 | ↓ | 9.06 |
| YBR189W | RPS9B | 10075.22 | 2150.89 | ↓ | 4.68 |
| YOR293W | RPS10A | 51787.23 | 12110.74 | ↓ | 4.28 |
| YDR064W | RPS13 | 9736.57 | 1587.67 | ↓ | 6.13 |
| YDR450W | RPS18A | 37913.71 | 5674.60 | ↓ | 6.68 |
| YML026C | RPS18B | 14458.01 | 2027.28 | ↓ | 7.13 |
| YKL156W | RPS27A | 23725.18 | 11117.26 | ↓ | 2.13 |
| YLR167W | RPS31 | 38648.54 | 2611.97 | ↓ | 14.80 |
| YJL138C | TIF2 | 20154.61 | 7264.66 | ↓ | 2.77 |
| \multicolumn{6}{c}{Cellular role: Energy metabolism} ||||||
| YGR183C | QCR9 | 57357.59 | 80447.53 | ↑ | 1.40 |
| YDL004W | ATP16 | 25047.95 | 10988.51 | ↓ | 2.28 |
| YKL150W | MCR1 | 50931.46 | 37076.83 | ↓ | 1.37 |
| YLR038C | COX12 | 39506.06 | 29534.70 | ↓ | 1.34 |
| \multicolumn{6}{c}{Cellular role: Unknown} ||||||
| YDR442W | | 14654.61 | 2242.42 | ↓ | 6.54 |
| YDR134C | | 17025.59 | 10561.72 | ↓ | 1.61 |
| YHR056C | RSC30 | 81350.52 | 31447.10 | ↓ | 2.59 |
| YKR040C | | 48390.21 | 90125.88 | ↑ | 1.86 |
| YLR414C | | 13463.40 | 8085.92 | ↓ | 1.67 |
| YLR312C | | 25589.67 | 16184.57 | ↓ | 1.58 |
| YJL188C | BUD19 | 22074.09 | 4526.39 | ↓ | 4.88 |
| YOR285W | | 75099.98 | 61896.00 | ↓ | 1.21 |
| YOL109W | ZEO1 | 66287.15 | 35502.43 | ↓ | 1.87 |
| \multicolumn{6}{c}{Cellular role: Chromatine structure} ||||||
| YBR009C | HHF1 | 11173.15 | 5416.74 | ↓ | 2.06 |
| YNL030W | HHF2 | 31366.74 | 20132.23 | ↓ | 1.56 |
| \multicolumn{6}{c}{Cellular role: Nucleotide metabolism} ||||||
| YDR399W | HPT1 | 13339.03 | 5333.81 | ↓ | 2.50 |
| \multicolumn{6}{c}{Cellular role: Polymerase II transcription} ||||||
| YEL009C | GCN4 | 34617.98 | 20798.63 | ↓ | 1.66 |
| YPL037C | EGD1 | 17862.37 | 8229.01 | ↓ | 2.17 |
| \multicolumn{6}{c}{Cellular role: Vesicular transport} ||||||
| YBL078C | AUT7 | 42661.70 | 32333.01 | ↓ | 1.32 |
| YOR327C | SNC2 | 22716.56 | 13704.48 | ↓ | 1.66 |
| \multicolumn{6}{c}{Cellular role: Small molecule transport} ||||||
| YHR039C-B | VMA10 | 44429.30 | 23826.51 | ↓ | 1.86 |
| \multicolumn{6}{c}{Cellular role: Cell wall maintenance} ||||||
| YKL097W-A | CWP2 | 13529.93 | 1617.20 | ↓ | 8.37 |
| \multicolumn{6}{c}{Cellular role: Carbohydrate metabolism} ||||||
| YKL060C | FBA1 | 33329.74 | 10367.82 | ↓ | 3.21 |

TABLE 7

| Sequence ID NO | ORF | GENE | 30 min | 1 h | 2 h | 3 h | 6 h |
|---|---|---|---|---|---|---|---|
| SEQ ID NO 17 | YAL003W | EFB1 | | | 1.90 | | |
| SEQ ID NO 19 | VAL060W | FUN49 | | | -2.00 | | |
| SEQ ID NO 21 | YBL002W | HTB2 | -4.69 | | 1.54 | | |
| SEQ ID NO 23 | YBL058W | SHP1 | | | 1.77 | | |
| SEQ ID NO 25 | YBL064C | PRX1 | 1.90 | | 1.32 | | |
| SEQ ID NO 27 | YBL072C | RPS8A | | | | | -5.32 |
| SEQ ID NO 29 | YBL081W | | 1.01 | 1.86 | | | |
| SEQ ID NO 31 | YBL085W | BOI1 | 2.42 | 1.52 | | -1.39 | |
| SEQ ID NO 33 | YBL092W | RPL32 | | | | 2.76 | -9.18 |
| SEQ ID NO 35 | YBL109W | | 1.89 | 2.76 | 1.51 | -1.13 | |

TABLE 7-continued

| Sequence ID NO | ORF | GENE | 30 min | 1 h | 2 h | 3 h | 6 h |
|---|---|---|---|---|---|---|---|
| SEQ ID NO 37 | YBR009C | HHF1 | −3.99 | | | | −2.06 |
| SEQ ID NO 39 | YBR019C | GAL10 | | | | 5.08 | |
| SEQ ID NO 41 | YBR039W | ATP3 | | | −3.70 | | |
| SEQ ID NO 43 | YBR050C | REG2 | 3.07 | 2.11 | | | |
| SEQ ID NO 45 | YBR062C | | | | 2.02 | | |
| SEQ ID NO 47 | YBR089C-A | NHP6B | −3.60 | | | | |
| SEQ ID NO 49 | YBR101C | | | | 1.43 | | |
| SEQ ID NO 51 | YBR112C | SSN6 | 2.45 | 1.29 | | | |
| SEQ ID NO 53 | YBR133C | HSL7 | 2.00 | 2.84 | 1.28 | −1.47 | |
| SEQ ID NO 55 | YBR139W | | | | −2.60 | | |
| SEQ ID NO 57 | YBR149W | ARA1 | −3.70 | | −3.11 | | |
| SEQ ID NO 59 | YBR189W | RPS9B | | | | | −4.68 |
| SEQ ID NO 61 | YBR191W | RPL21A | | | | | −8.46 |
| SEQ ID NO 63 | YBR289W | SNF5 | 2.18 | | 1.11 | | |
| SEQ ID NO 65 | YCL035C | GRX1 | −6.40 | | −2.20 | | −2.45 |
| SEQ ID NO 67 | YCL052C | PBN1 | | | 1.55 | | |
| SEQ ID NO 69 | YCR004C | YCP4 | 4.09 | | | | |
| SEQ ID NO 71 | YCR005C | CIT2 | | | | 2.16 | |
| SEQ ID NO 73 | YCR009C | RVS161 | | | 1.83 | | |
| SEQ ID NO 75 | YCR010C | | | | −1.40 | | |
| SEQ ID NO 77 | YCR013C | | 3.80 | | | | |
| SEQ ID NO 79 | YCR021C | HSP30 | | | −2.20 | | |
| SEQ ID NO 81 | YDL004W | ATP16 | −12.16 | | | | −2.28 |
| SEQ ID NO 83 | YDL059C | RAD59 | 6.72 | | | | |
| SEQ ID NO 85 | YDL075W | RPL31A | | | | | −4.58 |
| SEQ ID NO 87 | YDL147W | RPN5 | 1.66 | | 2.14 | | |
| SEQ ID NO 89 | YDR064W | RPS13 | | | | | −6.13 |
| SEQ ID NO 91 | YDR073W | SNF11 | | | 1.89 | | |
| SEQ ID NO 93 | YDR099W | BMH2 | 1.86 | 1.29 | 1.32 | −1.13 | 1.99 |
| SEQ ID NO 95 | YDR133C | | | | −1.32 | −1.20 | |
| SEQ ID NO 97 | YDR134C | | | | −4.94 | −7.40 | −1.61 |
| SEQ ID NO 99 | YDR145W | TAF61 | 1.89 | 2.77 | | | |
| SEQ ID NO 101 | YDR154C | | | 3.55 | 2.65 | 1.58 | |
| SEQ ID NO 103 | YDR171W | HSP42 | | | | | 2.02 |
| SEQ ID NO 105 | YDR178W | SDH4 | | | −2.30 | | |
| SEQ ID NO 107 | YDR202C | RAV2 | | | 1.35 | | |
| SEQ ID NO 109 | YDR216W | ADR1 | −3.42 | 3.11 | | | |
| SEQ ID NO 111 | YDR224C | HTB1 | −2.91 | 4.07 | 1.22 | | |
| SEQ ID NO 113 | YDR253C | MET32 | 2.58 | | | | |

TABLE 7-continued

| Sequence ID NO | ORF | GENE | 30 min | 1 h | 2 h | 3 h | 6 h |
|---|---|---|---|---|---|---|---|
| SEQ ID NO 115 | YDR256C | CTA1 | | | −2.20 | | |
| SEQ ID NO 117 | YDR276C | SNA1 | −13.38 | | −1.50 | | |
| SEQ ID NO 119 | YDR342C | HXT7 | −2.76 | −2.94 | −2.70 | | |
| SEQ ID NO 121 | YDR343C | HXT6 | −2.40 | −7.17 | −8.40 | | |
| SEQ ID NO 123 | YDR345C | HXT3 | −22.45 | −1.89 | −1.30 | 1.82 | |
| SEQ ID NO 125 | YDR366C | | 1.44 | 3.18 | 2.34 | | |
| SEQ ID NO 127 | YDR377W | ATP17 | −19.05 | | | | |
| SEQ ID NO 129 | YDR399W | HPT1 | | | | | −2.50 |
| SEQ ID NO 131 | YDR418W | RPL12B | | | | | −9.27 |
| SEQ ID NO 133 | YDR513W | TTR1 | −1.68 | | | | −1.54 |
| SEQ ID NO 135 | YDR544C | | 1.99 | 2.55 | 1.53 | −1.85 | |
| SEQ ID NO 137 | YDR545W | YRF1-1 | | | −1.75 | | |
| SEQ ID NO 139 | YEL009C | GCN4 | −5.46 | | | | −1.66 |
| SEQ ID NO 697 | YEL032W | MCM3 | 1.89 | | | | |
| SEQ ID NO 141 | YEL039C | CYC7 | −5.06 | | | | |
| SEQ ID NO 143 | YEL071W | DLD3 | 3.09 | 1.81 | 1.29 | | |
| SEQ ID NO 145 | YER103W | SSA4 | | | 1.80 | | |
| SEQ ID NO 147 | YER112W | USS1 | 2.46 | | | | |
| SEQ ID NO 149 | YER150W | SPI1 | | | −2.40 | | |
| SEQ ID NO 151 | YER177W | BMH1 | 1.96 | 1.95 | | | |
| SEQ ID NO 153 | YFR010W | UBP6 | −2.28 | | | | |
| SEQ ID NO 155 | YFR033C | QCR6 | | | 1.46 | | |
| SEQ ID NO 157 | YFR052W | RPN12 | 2.66 | | | | |
| SEQ ID NO 159 | YGL072C | | −6.20 | | −1.80 | | |
| SEQ ID NO 161 | YGL080W | | −7.28 | | −1.90 | | |
| SEQ ID NO 163 | YGL123W | RPS2 | | | | | −5.57 |
| SEQ ID NO 165 | YGR008C | STF2 | −5.83 | | | | |
| SEQ ID NO 167 | YGR023W | MTL1 | 2.67 | | | | |
| SEQ ID NO 169 | YGR034W | RPL26B | 1.04 | | | | |
| SEQ ID NO 171 | YGR069W | | 1.67 | | −1.20 | | |
| SEQ ID NO 173 | YGR070W | ROM1 | 2.34 | | | | |
| SEQ ID NO 175 | YGR086C | | | | −1.50 | | |
| SEQ ID NO 177 | YGR132C | PHB1 | −2.76 | | 1.61 | | |
| SEQ ID NO 179 | YGR135W | PRE9 | −7.24 | | | | |
| SEQ ID NO 181 | YGR155W | CYS4 | 4.61 | | | | |
| SEQ ID NO 183 | YGR192C | TDH3 | | −2.72 | | | |
| SEQ ID NO 185 | YGR197C | SNG1 | | | 2.20 | | |
| SEQ ID NO 187 | YGR209C | TRX2 | | | 1.24 | −1.14 | |

TABLE 7-continued

| Sequence ID NO | ORF | GENE | 30 min | 1 h | 2 h | 3 h | 6 h |
|---|---|---|---|---|---|---|---|
| SEQ ID NO 189 | YGR243W | | | 1.94 | | | |
| SEQ ID NO 191 | YGR250C | | | | 1.99 | | |
| SEQ ID NO 193 | YHL021C | | | −5.37 | | | |
| SEQ ID NO 195 | YHR001W-A | QCR10 | | | 1.89 | | |
| SEQ ID NO 197 | YHR039C-B | VMA10 | −7.08 | | −2.00 | | −1.86 |
| SEQ ID NO 199 | YHR053C | CUP1A | −1.68 | 1.95 | 1.94 | 3.19 | −5.33 |
| SEQ ID NO 201 | YHR055C | CUP1B | −2.77 | 2.33 | 4.12 | 2.97 | −4.06 |
| SEQ ID NO 203 | YHR056C | | −1.25 | 2.41 | 2.05 | 1.56 | −2.59 |
| SEQ ID NO 205 | YHR094C | HXT1 | −15.94 | | −1.60 | | |
| SEQ ID NO 207 | YHR095W | | | 2.42 | | | |
| SEQ ID NO 209 | YHR138C | | | −5.37 | | | |
| SEQ ID NO 211 | YHR161C | YAP180A | | 2.30 | 2.99 | 1.29 | |
| SEQ ID NO 213 | YHR162W | | | | 2.41 | 1.27 | |
| SEQ ID NO 215 | YHR179W | OYE2 | | 17.58 | | | |
| SEQ ID NO 217 | YIL057C | | | −31.34 | | −7.50 | 3.17 |
| SEQ ID NO 219 | YIL074C | SER33 | | 4.20 | | | |
| SEQ ID NO 221 | YIR037W | GPX3 | | 2.77 | | | |
| SEQ ID NO 223 | YJL138C | TIF2 | | | | | −2.77 |
| SEQ ID NO 225 | YJL142C | | | | 1.65 | | |
| SEQ ID NO 227 | YJL144W | | | | −3.30 | | |
| SEQ ID NO 229 | YJL161W | | | −6.29 | | | |
| SEQ ID NO 231 | YJL166W | QCR8 | | | 1.58 | | |
| SEQ ID NO 233 | YJR096W | | | −2.04 | | | |
| SEQ ID NO 235 | YJR115W | | | 1.58 | 1.16 | 1.38 | −1.08 |
| SEQ ID NO 237 | YKL054C | VID31 | | 2.13 | 2.37 | | |
| SEQ ID NO 239 | YKL060C | FBA1 | | | 1.31 | | −3.21 |
| SEQ ID NO 241 | YKL065C | YET1 | | −5.43 | −1.55 | | |
| SEQ ID NO 243 | YKL066W | | | | 2.76 | 1.87 | |
| SEQ ID NO 245 | YKL097W-A | CWP2 | | | | | −8.37 |
| SEQ ID NO 247 | YKL117W | SBA1 | | | −7.43 | | |
| SEQ ID NO 249 | YKL150W | MCR1 | | −3.43 | 1.39 | | −1.37 |
| SEQ ID NO 251 | YKL156W | RPS27A | | | | | −2.13 |
| SEQ ID NO 253 | YKL196C | YKT6 | | −6.55 | | | |
| SEQ ID NO 255 | YKR040C | | | 1.98 | | 1.24 | 1.86 |
| SEQ ID NO 257 | YKR075C | | | | 1.57 | | |
| SEQ ID NO 259 | YKR076W | ECM4 | | 4.88 | | | |
| SEQ ID NO 261 | YKR092C | SRP40 | | 2.70 | | | |
| SEQ ID NO 263 | YKR097W | PCK1 | | | 1.67 | −2.43 | |
| SEQ ID NO 265 | YLR029C | RPL15A | | | | | −3.98 |

TABLE 7-continued

| Sequence ID NO | ORF | GENE | 30 min | 1 h | 2 h | 3 h | 6 h |
|---|---|---|---|---|---|---|---|
| SEQ ID NO 267 | YLR038C | COX12 | −9.66 | | | | −1.34 |
| SEQ ID NO 269 | YLR043C | TRX1 | −13.13 | | −2.78 | | |
| SEQ ID NO 271 | YLR053C | | | 2.50 | 1.91 | | |
| SEQ ID NO 273 | YLR109W | AHP1 | | −6.83 | | | |
| SEQ ID NO 275 | YLR110C | | | | −9.13 | −6.07 | |
| SEQ ID NO 277 | YLR206W | ENT2 | | | 2.40 | | |
| SEQ ID NO 279 | YLR216C | CPR6 | 3.24 | | 1.61 | | |
| SEQ ID NO 281 | YLR294C | | | | 5.74 | 2.43 | |
| SEQ ID NO 283 | YLR311C | | 3.02 | 3.99 | 2.22 | | |
| SEQ ID NO 285 | YLR312C | | | | | | −1.58 |
| SEQ ID NO 287 | YLR327C | | −2.10 | 1.04 | 2.48 | | |
| SEQ ID NO 289 | YLR346C | | | | 1.79 | | |
| SEQ ID NO 291 | YLR390W | ECM19 | 2.77 | | | | |
| SEQ ID NO 293 | YLR414C | | | | | | −1.67 |
| SEQ ID NO 295 | YML053C | | | 2.80 | | | |
| SEQ ID NO 297 | YML129C | COX14 | | | 1.91 | | |
| SEQ ID NO 299 | YML132W | COS3 | | | 1.42 | | |
| SEQ ID NO 301 | YMR009W | | | | −2.17 | | |
| SEQ ID NO 303 | YMR011W | HXT2 | | | −1.86 | | |
| SEQ ID NO 305 | YMR043W | MCM1 | | 2.15 | 2.56 | 1.16 | |
| SEQ ID NO 307 | YMR099C | | | | 1.63 | | |
| SEQ ID NO 309 | YMR107W | | −6.48 | 5.86 | | | |
| SEQ ID NO 311 | YMR110C | | | | 1.53 | | |
| SEQ ID NO 313 | YMR173W | DDR48 | −3.32 | 1.58 | | −2.07 | |
| SEQ ID NO 691 | YMR173W-A | | −1.78 | 1.58 | 1.47 | −2.07 | |
| SEQ ID NO 315 | YMR251W | | −64.41 | | | | |
| SEQ ID NO 317 | YMR251W-A | HOR7 | −64.41 | | −4.19 | | −3.18 |
| SEQ ID NO 319 | YMR256C | COX7 | | | 3.79 | 2.18 | |
| SEQ ID NO 321 | YMR273C | ZDS1 | 2.42 | | | | |
| SEQ ID NO 323 | YNL030W | HHF2 | −3.97 | | | | −1.56 |
| SEQ ID NO 325 | YNL031C | HHT2 | | | −5.69 | | |
| SEQ ID NO 327 | YNL112W | DBP2 | 2.82 | | | | |
| SEQ ID NO 329 | YNL131W | TOM22 | −9.70 | | | | |
| SEQ ID NO 331 | YNL134C | | | | 1.52 | | |
| SEQ ID NO 333 | YNL143C | | 1.12 | | | | |
| SEQ ID NO 335 | YNL179C | | 2.88 | | −2.02 | | |
| SEQ ID NO 337 | YNL338W | | 1.78 | 2.79 | 1.62 | −2.87 | |
| SEQ ID NO 339 | YNR002C | FUN34 | | | −1.87 | | |

TABLE 7-continued

| Sequence ID NO | ORF | GENE | 30 min | 1 h | 2 h | 3 h | 6 h |
|---|---|---|---|---|---|---|---|
| SEQ ID NO 709 | YOL052C-A | DDR2 | | | | 1.65 | |
| SEQ ID NO 341 | YOL106W | | | | 3.51 | 2.44 | |
| SEQ ID NO 343 | YOL109W | ZEO1 | | | -3.45 | | -1.87 |
| SEQ ID NO 345 | YOL126C | MDH2 | | | 1.91 | -3.11 | |
| SEQ ID NO 347 | YOL139C | CDC33 | | | 2.17 | | |
| SEQ ID NO 349 | YOL150C | | 17.69 | | | | |
| SEQ ID NO 351 | YOL151W | GRE2 | 9.20 | | | | |
| SEQ ID NO 353 | YOR120W | GCY1 | | | -1.46 | | |
| SEQ ID NO 355 | YOR121C | | | 1.54 | 3.40 | 1.63 | |
| SEQ ID NO 357 | YOR122C | PFY1 | | | 1.40 | | |
| SEQ ID NO 359 | YOR131C | | 2.81 | | | | |
| SEQ ID NO 361 | YOR261C | RPN8 | | | 2.59 | 1.54 | |
| SEQ ID NO 363 | YOR267C | | | 1.76 | 1.07 | -1.10 | |
| SEQ ID NO 365 | YOR285W | | | -2.15 | | | -1.21 |
| SEQ ID NO 367 | YOR286W | | | -18.36 | | | |
| SEQ ID NO 369 | YOR327C | SNC2 | | | | | -1.66 |
| SEQ ID NO 371 | YOR372C | NDD1 | | 2.19 | 1.92 | | |
| SEQ ID NO 373 | YOR374W | ALD4 | | | -12.93 | | |
| SEQ ID NO 375 | YOR382W | | | 4.02 | | | |
| SEQ ID NO 377 | YPL037C | EGD1 | -5.83 | | | -2.17 | |
| SEQ ID NO 379 | YPL078C | ATP4 | -4.50 | | 1.22 | | |
| SEQ ID NO 381 | YPL079W | RPL21B | | | | -6.18 | |
| SEQ ID NO 383 | YPL085W | SEC16 | 2.28 | | | | |
| SEQ ID NO 385 | YPL089C | RLM1 | | 1.94 | 2.74 | 1.22 | |
| SEQ ID NO 387 | YPL190C | NAB3 | | 2.80 | | | |
| SEQ ID NO 389 | YPL201C | | -3.57 | | | | |
| SEQ ID NO 391 | YPL271W | ATP15 | | | 2.40 | | |
| SEQ ID NO 393 | YPR028W | YIP2 | -12.41 | | | | |
| SEQ ID NO 395 | YPR035W | GLN1 | | | -2.78 | | |

TABLE 8

| | C. albicans 522 CDS's | | | | S. cerevisiae 11645 CDS's | |
|---|---|---|---|---|---|---|
| aa codons | frequency: per thousand | total number | codon chosen for synthCaBAX gene | codons used in wt muBAX gene | frequency: per thousand | total number |
| Ala GCU | 30.7 | 8686 | x | 6 | 21.1 | 118595 |
| GCC | 12.7 | 3582 | | 4 | 12.6 | 70785 |
| GCA | 15.4 | 4357 | | 2 | 16.2 | 91018 |
| GCG | 2 | 578 | | 1 | 6.1 | 34546 |
| Arg CGU | 5.9 | 1682 | | 1 | 6.5 | 36518 |
| CGC | 0.7 | 204 | | 1 | 2.6 | 14571 |
| CGA | 3.5 | 989 | | 3 | 3 | 16957 |
| CGG | 0.8 | 220 | | 3 | 1.7 | 9801 |

TABLE 8-continued

| | | C. albicans 522 CDS's | | | | S. cerevisiae 11645 CDS's | |
|---|---|---|---|---|---|---|---|
| aa | codons | frequency: per thousand | total number | codon chosen for synthCaBAX gene | codons used in wt muBAX gene | frequency: per thousand | total number |
| | AGA | 23.6 | 6673 | x | 1 | 21.3 | 119672 |
| | AGG | 2.7 | 769 | | 2 | 9.3 | 52057 |
| Asn | AAU | 37.9 | 10731 | x | 1 | 36 | 202351 |
| | AAC | 18.7 | 5293 | | 2 | 24.9 | 140194 |
| Asp | GAU | 43.6 | 12323 | x | 5 | 37.8 | 212658 |
| | GAC | 14.7 | 4152 | | 7 | 20.4 | 114451 |
| Cys | UGU | 9.7 | 2757 | x | 1 | 8 | 44797 |
| | UGC | 1.7 | 493 | | 1 | 4.7 | 26357 |
| Gln | CAA | 35.2 | 9964 | x | 1 | 27.5 | 154529 |
| | CAG | 6.9 | 1948 | | 8 | 12.2 | 68463 |
| Glu | GAA | 49.5 | 14001 | X | 3 | 45.9 | 257930 |
| | GAG | 11.5 | 3252 | | 10 | 19.1 | 107568 |
| Gly | GGU | 33.5 | 9492 | x | 2 | 23.9 | 134515 |
| | GGC | 4.5 | 1281 | | 7 | 9.7 | 54629 |
| | GGA | 13.7 | 3874 | | 2 | 10.9 | 61481 |
| His | GGG | 7.7 | 2182 | | 8 | 6 | 33627 |
| | CAU | 14 | 3964 | | | 13.7 | 77260 |
| | CAC | 5.8 | 1642 | | | 7.8 | 43878 |
| Ile | AUU | 39.9 | 11281 | | 3 | 30.2 | 169795 |
| | AUC | 14.2 | 4005 | x | 7 | 17.1 | 96126 |
| | AUA | 12.3 | 3478 | | | 17.8 | 100027 |
| Leu | UUA | 1 | 295 | | | 26.3 | 148133 |
| | UUG | 36.1 | 10204 | x | 2 | 27.1 | 152590 |
| | CUU | 9.8 | 2777 | | 2 | 12.2 | 68479 |
| | CUC | 2.5 | 694 | | 7 | 5.4 | 30218 |
| | CUA | 4 | 1133 | | 1 | 13.4 | 75414 |
| Lys | AAA | 48.6 | 13760 | x | 2 | 42.1 | 236546 |
| | AAG | 19.4 | 5477 | | 6 | 30.8 | 173174 |
| Met | AUG | 18.4 | 5219 | x | 8 | 20.9 | 117410 |
| Phe | UUU | 28.6 | 8100 | | 4 | 26 | 146355 |
| | UUC | 15.9 | 4486 | x | 7 | 18.2 | 102389 |
| Pro | CCU | 13.2 | 3722 | | 1 | 13.6 | 76366 |
| | CCC | 3.6 | 1027 | | 5 | 6.8 | 38247 |
| | CCA | 26.6 | 7531 | x | | 18.2 | 102277 |
| | CCG | 2.4 | 686 | | 1 | 5.3 | 29758 |
| Ser | CUG | 3.1 | 875 | | 9 | 10.4 | 58583 |
| | UCU | 23.3 | 6595 | x | 1 | 23.6 | 132608 |
| | UCC | 10.3 | 2928 | | 4 | 14.2 | 79928 |
| | UCA | 24.6 | 6955 | | | 18.8 | 105570 |
| | UCG | 6.5 | 1836 | | 1 | 8.6 | 48186 |
| | AGU | 23.6 | 6673 | | | 14.2 | 79649 |
| | AGC | 4.5 | 1269 | | 5 | 9.7 | 54330 |
| Thr | ACU | 30.7 | 8689 | | 1 | 20.2 | 113634 |
| | ACC | 13.9 | 3928 | x | 8 | 12.6 | 70777 |
| | ACA | 17.4 | 4928 | | 5 | 17.7 | 99759 |
| | ACG | 3.6 | 1019 | | 1 | 8 | 44817 |
| Trp | UGG | 11 | 3115 | x | 6 | 10.3 | 58092 |
| Tyr | UAU | 24 | 6782 | | | 18.8 | 105489 |
| | UAC | 11.6 | 3280 | x | 2 | 14.7 | 82483 |
| Val | GUU | 33.2 | 9391 | | 1 | 22 | 123726 |
| | GUC | 10.3 | 2927 | x | 3 | 11.6 | 65203 |
| | GUA | 8 | 2265 | | | 11.8 | 66100 |
| | GUG | 10 | 2842 | | 7 | 10.7 | 60033 |

TABLE 9

Regulation of 23 selected "Bax.specific" functions

| ORF | Gene | Control | Bax | H2O2 | B vs C |
|---|---|---|---|---|---|
| Cellular role: Amino-acid metabolism ||||||
| YOR302W | YOR302W | 11541.92 | 26806.35 | 8895.74 | 2.32 |
| Cellular role: Cell stress ||||||
| YML028W | TSA1 | 12889.91 | 2166.45 | 11327.36 | 0.17 |
| Cellular role: Chromatin/chromosome structure ||||||
| YBR009C | HHF1 | 2149.69 | 8655.43 | 2909.14 | 4.03 |
| YDR224C | HTB1 | 13661.40 | 55656.34 | 18829.27 | 4.07 |
| YNL030W | HHF2 | 8676.99 | 19603.93 | 4732.39 | 2.26 |
| Cellular role: Energy generation ||||||
| YBL099W | ATP1 | 2728.21 | 8786.71 | 1644.48 | 3.22 |
| YGR183C | QCR9 | 23181.54 | 81865.40 | 24053.00 | 3.53 |
| YJL166W | QCR8 | 5296.71 | 18093.93 | 5001.65 | 3.42 |
| YLR038C | COX12 | 7336.65 | 19935.69 | 5118.43 | 2.72 |
| Cellular role: Signal transduction ||||||
| YHR135C | YCK1 | 3939.64 | 8358.11 | 3707.17 | 2.12 |
| YOL100W | PKH2 | 2218.45 | 6088.96 | 2619.31 | 2.74 |
| Cellular role: Transcription factor ||||||
| YDR216W | ADR1 | 5925.91 | 18459.00 | 6434.43 | 3.11 |
| Cellular role: Unknown ||||||
| YDR504C | YDR504C | 2741.47 | 6908.49 | 2839.62 | 2.52 |
| YGR146C | YGR146C | 2099.74 | 5616.94 | 1303.89 | 2.68 |
| YGR236C | SPG1 | 17717.80 | 64439.96 | 24134.29 | 3.64 |
| YHR138C | YHR138C | 6218.30 | 14817.41 | 5220.50 | 2.38 |
| YJL142C | YJL142C | 6988.27 | 16006.02 | 6740.46 | 2.29 |
| YKL123W | YKL123W | 2826.82 | 5952.34 | 2766.04 | 2.11 |
| YLR414C | YLR414C | 4510.80 | 11867.69 | 3531.27 | 2.63 |
| YMR107W | YMR107W | 13453.15 | 78850.98 | 17417.00 | 5.86 |
| YOL099C | YOL099C | 3690.45 | 11604.72 | 5454.15 | 3.14 |
| YPL201C | YPL201C | 15960.14 | 33633.74 | 7449.66 | 2.11 |
| YJL060W | YJL060W | 8798.50 | 2406.39 | 6356.11 | 0.27 |

REFERENCES

Altshul, S. F., Gish, W., Miller, W., Myers, E. W. and Lipman D. J. (1990). Basic ocal alignment search tool. *J. Mol. Biol.* 215, 403–410.

Apte, S. S., M. G. Mattei M. F. Seldin and B. R. Olsen (1995). "The highly conserved defender against the death 1 (DAD1) gene maps to human chromosome 14q11-q12 and mouse chromosome 14 and has plant and nematode homologs." *FEBS Lett* 363(3): 304–6.

Bairoch, A. and Apweiler, R. (1998). The SWISS-PROT protein sequence data bank and its supplement TrEMBL in 1998. *Nucleic acids Res.* 26, 38–42.

Bishop M. J., ed. (1994). Guide to Huge Computers, Academic Press, San Diego.

Brown, A. J., G. Bertram, et al. (1991). "Codon utilisation in the pathogenic yeast, *Candida albicans*." *Nucleic Acids Res* 19(15): 4298.

Carillo, H. and Lipton, D. (1988). *SIAM J. Applied Math.* 48, 1073.

Casadaban, M. J., and Cohen, S. N. (1980). Analysis of gene control signals by DNA fusion and cloning in *Escherichia coli*. *J. Mol. Biol.* 138, 179–207.

Chien, C. T., Bartel, P. L., Sternglanz, R., and Fields, S. (1991). The 2-hybrid system—a method to identify and clone genes for proteins that interact with a protein of interest. *Proc. Natl. Acad Sci USA* 88, 9578–9582.

Cormack, B. P., G. Bertram, et al. (1997). "Yeast-enhanced green fluorescent protein (yEGFP) a reporter of gene expression in *Candida albicans*." *Microbiology* 143(Pt 2): 303–11.

Devereux, J., Haeberli, P. and Smithies, O. (1984). A comprehensive set of sequence analysis programs for the VAX. *Nucleic Acids Research* 12, 387–395.

Fonzi, W. A. and M. Y. Irwin (1993). "Isogenic strain construction and gene mapping in *Candida albicans*." *Genetics* 134(3): 717–28.

Gatignol, A., Dassin, M. and Tiraby, G. (1990). Cloning of *Saccharomyces cerevisiae* promoters using a probe vector based on phleomycin resistance. *Gene* 91, 35–41.

Geysen, H. M., Rodda, S. J. and Mason, T. J. (1986). A priori delineation of a peptide which mimics a discontinuous antigenic determinant. *Mol. Immunol.* 23, 709–715.

Greenhalf, W., C. Stephan, and B. Chaudhuri (1996). "Role of mitochondria and C-terminal membrane anchor of Bcl-2 in Bax induced growth arrest and mortality in *Saccharomyces cerevisiae*." FEBS Lett 380(1–2): 169–75.

Herreros, E., M. I. Garcia-Saez, et al. (1992). "A reorganized *Candida albicans* DNA sequence promoting homologous non-integrative genetic transformation." Mol Microbiol 6(23): 3567–74.

Hinnebush, A. G. and Liebman, S. W., in: The Molecular Biology of the Yeast Saccharomyces (1991). Broach, J. R., Pringle, J. R. and Jones, E. W., eds., CSH Laboratory Press, NY.

Ink, B., M. Zornig, B. Baum, N. Hajibagheri, C. James, T. Chittenden and G. Evan (1997). "Human Bak induces cell death in *Schizosaccharomyces pombe* with morphological changes similar to those with apoptosis in mammalian cells." Mol Cell Biol 17(5): 2468–74.

Jürgenmeiser, J. M., Krajewski, S., Armstrong, R., Wilson, G. M., Oltersdorf, T., Fritz, L. C., Red, J. C., and Ottilie, S. (1997). Bax- and Bak-induced cell death in the fission yeast *Schizosaccharomyces pombe*. *Mol. Biol. Cell* 8, 325–329.

Knudson, C. M. and S. J. Korsmeyer (1997). "Bcl-2 and Bax function independently to regulate cell death." Nat Genet 16(4): 358–63.

Kohler, F. and Milstein, C. (1975). Continuous cultures of fused cells secreting antibody of predefined specificity. *Nature* 256, 495–497.

Kozak, M. (1981). "Possible role of flanking nucleotides in recognition of the AUG initiator codon by eukaryotic ribosomes." Nucleic Acids Res 9(20): 5233–62.

Ligr, M., Madeo, F., Froehlich, E., Hilt, W., Froehlich, K.-U. and Wolf, D. H. (1998). Mammalian Bax triggers apoptotic changes in yeast. *FEBS Lett.* 438, 61–65.

Lloyd, A. T. and P. M. Sharp (1992). "Evolution of codon usage patterns: the extent and nature of divergence between *Candida albicans* and *Saccharomyces cerevisiae*." Nucleic Acids Res 20(20): 5289–95.

Lockhart, D. J. Dong, H. Byrne, M. C., Follettie, M., Gallo, M. V., Chee, M. S., Mitteman, M., Wang, C., Kobayashi, M., Horton, H and Brown, E. L. (1996). Expression monitoring by hybridisation to high density oligonucleotide arrays. *Nature Biotechnology* 14, 1675–1680.

Madeo, F., Frohlich, E., Ligr, M., Grey, M., Sigrist, S. J., Wolf, D. H., and Frohlich, K. U. (1999). Oxygen stress: a regulator of apoptosis in yeast. J Cell Biol 145, 757–767.

Muchmore, S. W., M. Sattler, H. Liang, R. P. Meadows, J. E. Harlan, H. S. Yoon, D. Oltvai, Z. N. and S. J. Korsmeyer (1994). "Checkpoints of dueling dimers foil death wishes [comment]." Cell 79(2): 189–92.

Reed, J. C., J. M. Jurgensmeier, and S. Matsuyama (1998). "Bcl-2 family proteins and mitochondria." Biochim Biophys Acta 1366(1–2): 127–37.

RiboGene Inc., Patent application (1995) PCT WO 95/11969.

Rossanese, O. W., J. Soderholm, et al. (1999). "Golgi structure correlates with transitional endoplasmic reticulum organization in *Pichia pastoris* and *Saccharomyces cerevisiae*." J Cell Biol 145(1): 69–81.

Sambrook J., Fritsch E. F. and Maniatis, T. (1989). Molecular Cloning: A Laboratory Manual, 2$^{nd}$ Ed., CSH Laboratory Press, NY.

Sambrook, J., E. F. Fritsch, et al. (1989). Detection and Analysis of Proteins Expressed from Cloned Genes. Molecular Cloning: A Laboratory Manual. New York, Cold Spring Harbor Laboratory Press. 3: 18.35.

Sandbaken, M. G., Lupisella, J. A., DiDomenico, B., and Chakraburtty, K. (1990). Protein synthesis in yeast Structural and functional analysis of the gene encoding elongation factor III. *J. Biol. Chem.* 265, 15838–15844.

Sato, T., M. Hanada, S. Bodrug, S. Irie, N. Iwama, L. H. Boise, C. B. Thompson, E. Golemis, L. Fong, H. G. Wang and J. C. Reed (1994). "Interactions among members of the Bcl-2 protein family analyzed with a yeast two-hybrid system [published erratum appears in Proc Natl Acad Sci USA 1995 Feb. 28; 92(5):2016]." Proc Natl Acad Sci USA 91(20): 9238–42.

Sherman, F., Fink, G. R., and Hicks, J. B. (1979). Methods in yeast genetics, CSH Laboratory Press, NY.

Schiestl, R. H., and Gietz, D. R. (1989). High efficiency transformation of intact yeast cells using single stranded nucleic acids as a carrier. *Curr. Genet.* 16, 339–346.

Schwartz, L. M., S. W. Smith, M. E. Jones and B. A. Osborne (1993). "Do all programmed cell deaths occur via apoptosis?" Proc Natl Acad Sci USA 90(3): 980–4.

Stoesser, G., Moseley, M. A., /Sleep, J., McGowran, M., Garcia-Pastor, M. and Sterk, P. (1998). *Nucleic Acids Res.* 26, 8–15.

Walsh, T. J. (1992). Invasive Fungal Infections: Problems and Challenges for Developing New Antifungal Compounds, in: "Emerging Targets in Antibacterial and Antifungal Chemotherapy", J. A. Sutcliffe and N. H. Georgopapadakou, eds, Chapman and Hall, NY, pp 349–373.

Zha, H., H. A. Fisk, M. P. Yaffe, N. Mahajan, B. Herman and J. C. Reed (1996). "Structure-function comparisons of the proapoptotic protein Bax in yeast and mammalian cells." Mol Cell Biol 16(11): 6494–508

Zhu, J. (1986). One step selection of a multicopy integrant based on yeast genomic transformation. In "Heterologous gene expression in *Saccharomyces cerevisiae* using a dominant selection and amplification system". Ghent University, doctoral dissertation, p 45.

SEQUENCE LISTING (732 sequences)

SEQ ID NO: 1 - DNA, 579 bp, Candida albicans
atggatggttctggtgaacaattgggttctggtggtccaacctcttctgaacaaatcatgaaaaccggtgctttcttgttgcaaggtttcatccaagatagagctggtagaatggctggtgaaaccccagaattgaccttggaacaaccaccacaagatgcttctaccaaaaaattgtctgaatgtttgagaagaatcggtgatgaattggattctaacatggaattgcaaagaatgatcgctgatgtcgataccgattctccaagagaagtcttcttcagagtcgctgctgatatgttcgctgatggtaacttcaactggggtagagtcgtcgctttgttctacttcgcttctaaattggtcttgaaagctttgtgtaccaaagtcccagaattgatcagaaccatcatgggttggaccttggatttcttgagagaaagattgttggtctggatccaagatcaaggtggttgggaaggtttgttgtcttacttcggtaccccaacctggcaaaccgtcaccatcttcgtcgctggtgtcttgaccgcttctttgaccatctggaaaaaaatgggttaa

SEQ ID NO: 2 - protein, 192 aa, Candida albicans
MDGSGEQLGSGGPTSSEQIMKTGAFLLQGFIQDRAGRMAGETPELTLEQPPQDASTKKLSECLRRIGDELDSNMELQRMIADVDTDSPREVFFRVAADMFADGNFNWGRVVALFYFASKLVLKALCTKVPELIRTIMGWTLDFLRERLLVWIQDQGGWEGLLSYFGTPTWQTVTIFVAGVLTASLTIWKKMG

SEQ ID NO: 3 - DNA, 100 bp, Artificial Sequence
  Description of Artificial Sequence: Synthetic oligonucleotide
aactgcaggaagatcttccatggatggttctggtgaacaattgggttctggtggtccaacctcttctgaacaaatcatgaaaaccggtgctttcttgttg

SEQ ID NO: 4 - DNA, 100 bp, Artificial Sequence
  Description of Artificial Sequence: Synthetic oligonucleotide
tagaagcatcttgtggtggttgttccaaggtcaattctggggtttcaccagccattctaccagctctatcttggatgaaaccttgcaacaagaaagcacc

SEQ ID NO: 5 - DNA, 107 bp, Artificial Sequence
  Description of Artificial Sequence: Synthetic oligonucleotide
ggaattctcgacatcagcgatcattctttgcaattccatgttagaatccaattcatcaccgattcttctcaaacattcagacaattttttggtagaagcatcttgtg

SEQ ID NO: 6 - DNA, 87 bp, Artificial Sequence
  Description of Artificial Sequence: Synthetic oligonucleotide
ggaattcgctgatgtcgataccgattctccaagagaagtcttcttcagagtcgctgctgatatgttcgctgatggtaacttcaactg

SEQ ID NO: 7 - DNA, 90 bp, Artificial Sequence
  Description of Artificial Sequence: Synthetic oligonucleotide
aattctgggactttggtacacaaagctttcaagaccaatttagaagcgaagtagaacaaagcgacgactctaccccagttgaagttacca

SEQ ID NO: 8 - DNA, 90 bp, Artificial Sequence
  Description of Artificial Sequence: Synthetic oligonucleotide
ccaccttgatcttggatccagaccaacaatctttctctcaagaaatccaaggtccaacccatgatggttctgatcaattctgggactttg

SEQ ID NO: 9 - DNA, 80 bp, Artificial Sequence
  Description of Artificial Sequence: Synthetic oligonucleotide
attgttggtctggatccaagatcaaggtggttgggaaggtttgttgtcttacttcggtaccccaacctggcaaaccgtca

SEQ ID NO: 10 - DNA, 91 bp, Artificial Sequence
  Description of Artificial Sequence: Synthetic oligonucleotide
tcccccgggggattaacccatttttttccagatggtcaaagaagcggtcaagacaccagcgacgaagatggtgacggtttgccaggttggg

SEQ ID NO: 11 - DNA, 32 bp, Artificial Sequence
  Description of Artificial Sequence: Synthetic oligonucleotide
aactgcagatgtctaaaggtgaagaattattc

SEQ ID NO: 12 - DNA, 33 bp, Artificial Sequence
  Description of Artificial Sequence: Synthetic oligonucleotide
ggaagatcttcctttgtacaattcatccatacc

SEQ ID NO: 13 - DNA, 19 bp, Artificial Sequence
  Description of Artificial Sequence: Synthetic oligonucleotide
atggatggttctggtgaac

SEQ ID NO: 14 - DNA, 22 bp, Artificial Sequence
  Description of Artificial Sequence: Synthetic oligonucleotide
ttaacccatttttttccagatg

SEQ ID NO: 15 - DNA, 18 bp, Artificial Sequence
  Description of Artificial Sequence: Synthetic oligonucleotide
agagatctcgagggatcc

SEQ ID NO: 16 - DNA, 22 bp, Artificial Sequence
  Description of Artificial Sequence: Synthetic oligonucleotide
gcattatttgtacaattcatcc

SEQ ID NO: 17 - DNA, 1487 bp, Saccharomyces cerevisiae
ccgatggaacgttctggaaaaagaagaataatttaattactttctcaactaaaatctggagaaaaaacgcaaatgacagcttctaaacgttccgtgtgctttctttctagaatgttctggaaagtttacaacaatccacaagaacgaaaatgccgttgacaatgatgaaaccatcatccacacaccgcgcacacgtgctttatttctttttctgaattttttttttccgccattttcaaccaaggaaattttttttcttagggctcagaacctgcaggtgaagaagcgctttagaaatcaaagcacaacgtaacaatttgtcgacaaccgagcctttgaagaaaaaatttttcacattgtcgcctctaaataaatagtttaaggttatctacccactatatttagttggttcttttttttttccttctactctttatctttttacctcatgctttctacctttcagcactgaagagtccaaccgaatatatacacacataatggcatccaccgatttctccaagattgaaactttgaaacaattaaacgcttctttggctgacaagtcatacattgaagggtatgttccgatttagtttactttatagatcgttgtttttctttcttttttttttttcctatggttacatgtaaagggaagttaactaataatgattactttttttcgcttatgtgaatgatgaatttaattctttggtccgtgtttatgatgggaagtaagacccccgatatgagtgacaaaagagatgtggttgactatcacagtatctgacgatagcacagagcagagtatcattattagttatctgttatttttttttccttttttgttcaaaaaaagaaagacagagtctaaagattgcattacaagaaaaaagttctcattactaacaagcaaaatgttttgtttctccttttaaaatagtactgctgtttctcaagctgacgtcactgtcttcaaggctttccaatctgcttacccagaattctccagatggttcaaccacatcgcttccaaggccgatgaattcgactctttcccagctgcctctgctgccgctgccgaagaagaagaagatgacgatgtcgatttattcggttccgacgatgaagaagctgacgctgaagctgaaaagttgaaggctgaaagaattgccgcatacaacgctaagaaggctgctaagccagctaagccagctgctaagtccattgtcactctagatgtcaagccatgggatgatgaaaccaatttggaagaaatggttgctaacgtcaaggccatcgaaatggaaggtttgacctggggtgctcaccaatttatcccaattggtttcggtatcaagaagttgcaaattaactgtgttgtcgaagatgacaaggtttccttggatgacttgcaacaaagcattgaagaagacgaagaccacgtccaatctaccgatattgctgctatgcaaaaattataa

SEQ ID NO: 18 - protein, 206 aa, Saccharomyces cerevisiae
MASTDFSKIETLKQLNASLADKSYIEGTAVSQADVTVFKAFQSAYPEFSRWFNHIASKADEFDSFPAASAAAAEEEEDDDVDLFGSDDEEADAEAEKLKAERIAAYNAKKAAKPAKPAAKSIVTLDVKPWDDETNLEEMVANVKAIEMEGLTWGAHQFIPIGFGIKKLQINCVVEDDKVSLDDLQQSIEEDEDHVQSTDIAAMQKL

SEQ ID NO: 19 - DNA, 1649 bp, Saccharomyces cerevisiae
aaagactacgagaatcaataaacgaggctaaactgcgtcacacatgattgtgattgagtactcacgttctcgtgttaatcccgcggtcttcttgttttactaacttttctttctctcatagcattctcttgacagtgttttatatacatcatatgtacatttatcgagccaatcgagggcagcagtttaacatcaagccggatttgctcacgctactttgaccccttttcgtttcgacggagagaagaaaccggtgttttcctatccttgcctattctttcctccttacggggtcctagcctgtttctcttgatatgataataggtggaaacgtagaaaaaaaaatcgacatataaaagtggggcagatacttcgtgtgacaatggccaattcaagccctttgggcagatgttgcccttcttctttcttaaaaagtcttagtacgattgaccaagtcagaaaaaaaaaaaaaaaggaactaaaaaaagttttaattaattatgagagctttggcatatttcaagaagggtgatattcacttcactaatgatatccctaggccagaaatccaaaccgacgatgaggttattatcgacgtctcttggtgtgggatttgtggctcggatcttcacgagtacttggatggtccaatcttcatgcctaaagatggagagtgccataaattatccaacgctgctttacctctggcaatgggccatgagatgtcaggaattgtttccaaggttggtcctaaagtgacaaaggtgaaggttggcgaccacgtggtcgttgatgctgccagcagttgtgcggacctgcattgctggccacactccaaattttacaattccaaaccatgtgatgcttgtcagaggggcagtgaaaatctatgtacccacgccggttttgtaggactaggtgtgatcagtggtggctttgctgaacaagtcgtagtctctcaacatcacattatcccggttccaaaggaaattcctctagatgtggctgctttagttgagcctctttctgtcacctggcatgctgttaagatttctggtttcaaaaaaggcagttcagccttggttcttggtgcaggtcccattgggttgtgtaccattttggtacttaagggaatgggggctagtaaaattgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaa

SEQ ID NO: 20 - protein, 382 aa, Saccharomyces cerevisiae
MRALAYFKKGDIHFTNDIPRPEIQTDDEVIIDVSWCGICGSDLHEYLDGPIFMPKDGECHKLSNAALPLAMGHEMSGIVSKVGPKVTKVKVGDHVVVDAASSCADLHCWPHSKFYNSKPCDACQRGSENLCTHAGFVGLGVISGGFAEQVVVSQHHIIPVPKEIPLDVAALVEPLSVTWHAVKISGFKKGSSALVLGAGPIGLCTILVLKGMGASKIVVSEIAERRIEMAKKLGVEVFNPSKHGHKSIEILRGLTKSHDGFDYSYDCSGIQVTFETSLKALTFKGTATNIAVWGPKPVPFQPMDVTLQEKVMTGSIGYVVEAFEEVVRAIHNGDIAMEDCKQLITGKQRIEDGWEKGFQELMDHKESNVKILLTPNNHGEMK

SEQ ID NO: 21 - DNA, 896 bp, Saccharomyces cerevisiae
tgtttgatattagtagtcatgttgtaatctctggcctaagtatacgtaacgaaaatggtagcacgtcgcgtttatggcccccaggttaatgtgttctctgaaattcgcatcactttgagaaataatgggaacaccttacgcgtgagctgtgcccaccgcttcgcctaataaagcggtgttctcaaaatttctccccgttttcaggatcacgagcgccatctagttctggtaaaatcgcgcttacaagaacaaagaaaagaaacatcgcgtaatgcaacagtgagacacttgccgtcatatataaggttttggatcagtaaccgttatttgagcataacacaggtttttaaatatattattatatatcatggtatatgtgtaaaatttttttgctgactggttttgtttatttatttagctttttaaaaattttactttcttcttgttaattttttctgattgctctatactcaaaccaacaacaacttactctacaactaatgtcctctgccgccgaaaagaaaccagcttccaaagctccagctgaaaagaagccagctgccaagaaaacatcaacctccgtcgatggtaagaagagatctaaggttagaaaggagacctattcctcttatatttacaaagttttgaagcaaactcacccagacactggtatttcccagaagtctatgtctattttgaactctttcgttaacgatatctttgaaagaattgctactgaagcttctaaattggccgcttataacaagaaatccactatttctgctagagaaatccaaacagccgttagattgatcttacctggtgaattggctaaacatgccgtctccgaaggtactagggctgttaccaaatactcctcctctactcaagcctaa

SEQ ID NO: 22 - protein, 131 aa, Saccharomyces cerevisiae
MSSAAEKKPASKAPAEKKPAAKKTSTSVDGKKRSKVRKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 23 - DNA, 1772 bp, Saccharomyces cerevisiae
ttatttacatagtgccattgaacacttttcaagcaaactacgccagccggacgcagacaataacacacacacaaaagagtcttgcaggttctcttttagcggcaacgggcatgacactaggtatatttggtatgggcatcacagggacatgttggagctgggatgtttcatcatttcaggaactaaagcaacgtctggaaaggcgtgccaacaacgaatttgtagtgacaaacatgcctctggataaaagaagccagcaagtagtggacagcttagttaagacacacaattcatctctttgtaaatagtgttataccatagtagtagtttcaataatatattccactacttatatgtgttacccgcattagaactcttattggtggcgaaaatcgatggcaataaagaacggaaggggtttaatagttgtatgcttaacatatttcgatttaaatatataagaaacgtcggtagcacaacaattaactcattatttaggtatggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatga

SEQ ID NO: 24 - protein, 423 aa, Saccharomyces cerevisiae
MAEIPDETIQQFMALTNVSHNIAVQYLSEFGDLNEALNSYYASQTDDQKDRREEAHWNRQQEKALKQEAFSTNSSNKAINTEHVGGLCPKPGSSQGSNEYLKRKGSTSPEPTKGSSRSGSGNNSRFMSFSDMVRGQADDDDEDQPRNTFAGGETSGLEVTDPSDPNSLLKDLLEKARRGGQMGAENGFRDDEDHEMGANRFTGRGFRLGSTIDAADEVVEDNTSQSQRRPEKVTREITFWKEGFQVADGPLYRYDDPANSFYLSELNQGRAPLKLLDVQFGQEVEVNVYKKLDESYKAPTRKLGGFSGQGQRLGSPIPGESSPAEVPKNETPAAQEQPMPDNEPKQGDTSIQIRYANGKREVLHCNSTDTVKFLYEHVTSNANTDPSRNFTLNYAFPIKPISNDETTLKDADLLNSVVVQRWA

SEQ ID NO: 25 - DNA, 1286 bp, Saccharomyces cerevisiae
ttgccaacctcaaagaagaagaattatgggcatattgaccttctccggtttccctcccgcgctctcgtatccgtctgcatttgacctcgagcaagcgctccactatgtctatatgtttaccagtaaaacttcttaacgtttgtgatattttttgaacttcaaccacattcagtatgcgtgtgtatataaagatattcctgatagcactatgtttatctttatacaatatacaaaaggtcacccaggacgagcagcgcggctatttttctatcattccgtgaatagcgaccaacggtcggcggctatttttttttttgcaattttttcgggatgggttccccggcaaaagctagccccggagatttttaattacgtaaagaaacaaggggccggatgttgctgctattggtatataaagagagaaggagagatatagaaaattgtgcttctagattctcgcagtaggatgagataaatttcaaagaagcaggaagcaaaggatgtttagtagaatttgtagcgctcaattaaagaggacggcatggacccttcctaagcaggctcacttgcaatcacagacgattaaaacatttgccacagcacctattctgtgcaaacaattcaaacaaagtgatcaaccaagactaagaataaactctgatgctcctaactttgatgctgacacaacggttggtaaaatcaatttttacgactacttgggcgactcttggggggtcttgttttctcacccagcagatttcacccctgtctgcaccaccgaagtcagcgcattcgccaaattgaagccggaattcgacaagagaaatgttaaattgatcgggctttcagtggaagatgttgagtcccacgaaaaatggattcaagacatcaaggaaatagcaaaggttaaaaatgttggtttcccaataattggtgacacttttagaaacgtggcattcctatatgatatggtagatgccgaaggattcaaaaatatcaatgatgggtcactgaagaccgtgaggtctgttttcgtcatcgatcccaagaagaagattagactgatttttacctacccttccaccgtcggaagaaacacttctgaagtgttaagggtaatcgacgccttgcaattgactgacaaggagggcgtagtaactccaattaattggcagccagctgacgatgtcattattcctccctctgtctccaatgatgaggcgaaggctaaatttggtcaatttaatgaaattaaaccctatttaagattcaccaagtcgaaataa

SEQ ID NO: 26 - protein, 261 aa, Saccharomyces cerevisiae
MFSRICSAQLKRTAWTLPKQAHLQSQTIKTFATAPILCKQFKQSDQPRLRINSDAPNFDADTTVGKINFYDYLGDSWGVLFSHPADFTPVCTTEVSAFAKLKPEFDKRNVKLIGLSVEDVESHEKWIQDIKEIAKVKNVGFPIIGDTFRNVAFLYDMVDAEGFKNINDGSLKTVRSVFVIDPKKKIRLIFTYPSTVGRNTSEVLRVIDALQLTDKEGVVTPINWQPADDVIIPPSVSNDEAKAKFGQFNEIKPYLRFTKSK

SEQ ID NO: 27 - DNA, 1103 bp, Saccharomyces cerevisiae
gtcctacacacgagcatcgctgggaaagcttgagggctttctcttacgcagtgttcatggtgttacgggatggaactgtttcatatacgttatttacaggcctatcttaaagttataggaaattacacttgccatttgctttttggtactcacaagaagacgttataaacacaccaggacaaaaagtatgtgctatggtcatatgagtaatggaactacatattattttgaatgctacaggacctctctttgaatggaatagatagtggaaaaagtaaacttaactaaaagggatgatataaattgtgacaggagcagtgcactaaactgaatcctttgtgtaccccaaaaatcaagcctcttatgaaacgccgagtttttcacaagaagagatgaaaagaaaccaaagcatatttcaagataagaaaaaaattccgcaacttttgtacgttctttattttactaacaagcgtcattaaattttctattacagttacaaaatgggtatttctcgtgattctcgtcacaaaagatccgctaccggtgccaagcgtgctcaattcagaaagaagagaaagttcgaattaggccgtcaaccagccaacaccaagatcggtgctaagagaattcactctgttagaactagaggtggtaacaagaaatacagagctctaagaattgaaaccggtaacttttcttgggcttctgaaggtatctccaagaagaccagaattgctggtgttgtttaccatccatccaacaatgaattggttagaactaacactttgaccaaggctgccattgtccaaattgatgctactccattcagacaatggttcgaagctcactacggtcaaaccttgggtaagaagaagaacgtcaaggaagaagaaactgttgccaagagcaagaacgctgaaagaaagtgggctgctagagctgcttctgccaagatcgaatcttccgttgaatctcaattcagcgccggtagattatacgcttgtatctcttccagaccaggtcaatccggtagatgtgatggttacatcttggaaggtgaagaattagctttctacctaagaagattgactgctaagaaatag

SEQ ID NO: 28 - protein, 200 aa, Saccharomyces cerevisiae
MGISRDSRHKRSATGAKRAQFRKKRKFELGRQPANTKIGAKRIHSVRTRGGNKKYRALRIETGNFSWASEGISKKTRIAGVVYHPSNNELVRTNTLTKAAIVQIDATPFRQWFEAHYGQTLGKKKNVKEEETVAKSKNAERKWAARAASAKIESSVESQFSAGRLYACISSRPGQSGRCDGYILEGEELAFYLRRLTAKK

SEQ ID NO: 29 - DNA, 1607 bp, Saccharomyces cerevisiae
ttgttgcaacaattttgggatgcttctgcgtcgtacgaccctgtatttaccttctctagctcatcgcttcccagggtccacgttaatttttcaattttttcttgcgtgtcgaagattcaggtctcgagaaatttgtcaaaaatttttcactagatattaagaactatatacatcgaataagatgccagcacagaagagataggcaatcagtttagatactacagacactatccaatagtgcaaagcaaaagcagcatagaaaaaagagaatcccgtttccagctttttctctttttcccattcgtttttcctgatctttttttctgcatcgtggcacctagaacaagaggtaccttccatccttcgcttaatatttgatacgacttttttgatttccattattattatttgttactattattatttatcatttgggtttcggttttttgtaataattttcttttttttttttggctctatttcactaagacatcgtatatatgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttga

SEQ ID NO: 30 - protein, 368 aa, Saccharomyces cerevisiae
MPGQIISIPFLSQNEDMDKYLLEYRSLKLLHQSSNSFQSHNAPSHQSNYHPHYNHMKYNNTGSYYYYNNNNNSSVNPHNQAGLQSINRSIPSAPYGAYNQNRANDVPYMNTQKKHHRFSANNNLNQQKYKQYPQYTSNPMVTAHLKQTYPQLYYNSNVNAHNNNNNSNNNNNNNNNSNNNNNLYNQTQFSTRYFNSNSSPSLTSSTSNSSSPYNQSTFEYILPSTSAASTNLSSSSSNNSMHTNPTTATSTSADLINDLPVGPTSSSLISDLHSPPTVSFLPASQTLLMSSTTSSSIGTNINPPQHSPSPSQREDFSTAPVNMSSSASLLMNDSSLGWGSNHMNVSSSSQPASSRPFGIWNTDMSVWS

SEQ ID NO: 31 - DNA, 3443 bp, Saccharomyces cerevisiae
aaagggaagtatggcatgcctagaaatcttttctggaaaacttgaagcatatcatataattgtatgaacttgtccttcaaaagatgttaccaaatattcaagagtatgtgagctttctattctattgacgcgtaagaaaggctatcacgtgtgggggggagagctcagccacattgcactactttcgaaaccgcgtagtcggaaacgacattcccccgtaccaaaacaaacgaaaggacgtgaaaggtaaatgaataacatggcactaaaaatttggcagaaaacgaaaaaaaaaaggaaaaagaaactgaaaactatacgcttcccttaggatactttctgatttacatccgaagaattgggtgcgtcaattaaaggcaattcttcgctctatcaagcagttttactgcgtctgtctaaagaaacaattgttttactgaatttcaacaaagttctaactcgaggtgaccggaggccactgtaataataaaaaatagaagatgagtctcgaaggaaataccctaggcaaaggggccaaatcttttcctctgtatattgcggtaaatcagtactctaaacgaatggaggacgagctcaatatgaaaccaggtgataaaattaaagtcattactgatgatggggagtacaatgacggctggtattatgggcgcaatttgagaaccaaagaggaaggtttatacccagcggtatttaccaaaagaatagcaatagaaaaaccagagaacctgcacaaatcaccaacccaagagagtggaaattctggtgttaaatatggaaatttaaatgattctgcgagtaacataggtaaagtctcctcgcatcaacaggagaacagatatacatcattgaaaagtacaatgagcgatatagacaaagccttggaagagctaagaagtggttcagttgaacaagaggtatcaaaatcgcccacacgcgtgcccgaagttagcactccacagttgcaagatgaacagactttgattcaagaaaaaaccagaaatgaggaaaacacgacacatgactcgttattttctagcacagcggatttaaacttaagttctgaatctttgaagaatataagtaagtcaaatatatcaacaaaatccctagaaccgagttcggaatcagttcgtcaattagatttgaaaatggctaaaagttggagcccagaagaggttactgattactttagcttggttggatttgatcaatccacttgcaataaattcaaagagcatcaagtctccggaaaaatactactggaattagaactggaacacctaaaagaattggaaataaattcttttggtataagatttcagatattcaaagaaataaggaacatcaagtctgcaattgattcgtcgtcaaataaactggacgccgactactctacctttgcttttgaaaaccaagctgcccaactaatgcctgcagccactgtaaatagagacgaaatccaacaacaaatttcctccaagtgtaacaagttgtcaagtgaaagctctgatagaaaatcatcttcggtcaccacagaattgcaaagaccaagctcggttgttgttaatcccaattttaaacttcacgacccagctgagcagatcctagatatgacagaagttcctaatttgtttgctgataaagatattttcgaatcaccgggaagggctccaaaaccaccatcatatccaagtccagttcaacctccacaatcgccctcttttaataacaggtacacaaataataacgcaaggtttcctcctcaaacaacatatccacctaaaaacaagaacccaaccgtttattcaaatgggctaattccaaattcttcgacatcttccgataattcaacgggcaagttcaaattccctgccatgaatggtcatgactcgaactctaggaaaacaacactgacatctgctactataccttctattaacacggttaacacagatgaatctctacccgcaatttcaaatatatcttcaaatgctacatctcatcatccgaacagaaattccgttgtttacaataaccataagaggacggaatccggaagctcatttgttgatttgttcaacaggatttcaatgctatcgccagtcaagtcaagtttcgacgaagaagaaacgaaacaaccttcaaaagctagcagagcagtttttgactcagcacgcagaaagtcgtcttacggacattcaagagatgcctcactttctgaaatgaaaaagcataggagaaactcttctatattatcttttttttcttcaaaaagtcagtctaatccaacgtcaccaaccaaacaaactttcactatcgatcccgcaaagatgacttcccattctcgttctcagtcgaattcctattcgcatgcaagatcacaatcttactcccatagtagaaaacactcgttagttaccagccccttgaaaacttctttaagccctataaattccaaatccaatattgctttagcgcatagcgaaactcctactagtagtaataataaggaggcagtatcacaaccaagtgaagggaagcacaagcacaagcacaagcacaagagcaagcacaaacacaagaacagtagctccaaagatggctcttccgaagaaaaaagcaaaaagaaattatttagtagcaccaaagaatcatttgtaggaagcaaggaattcaaaagatctcccagtgaacttacccaaaaatctaccaaatcgatacttcccaggtcgaatgctaaaaagcaacaaacatctgcttttaccgaaggtatacgctctatcacagcaaaggaatctatgcaaactgcggactgttcaggctggatgagcaaaaaaggtaccggtgctatggggacttggaaacaacggtttttcacacttcatggaacaaggctttcttattttacgaataccaatgatgagaaggagcgtggcctgatagatataacggcacatagggtcttacctgccagtgatgatgataggctcatttccttatacgctgcgagcttaggaaaaggaaaatactgtttcaaattggtccctccgcaaccggggtccaaaaaggggctaacctttacagaacctcgcgttcactattttgcagttgagaataaatctgaaatgaaggcatggctgtcagccataataaaggccactattgatattgatacaagcgtccctgtcattagttcatatgccacaccaacgatacctctaagcaaggcacagacgctattggaagaagctaggttacaaacccagttaagagatgctgaagaggaagagggaagagatcaatttggatgggatgacacccaaaataaaagaaattctaattatccaatcgaacaagatcaatttgagaccagcgattacctggaaagttcagcatttgaataccctggtggcagactttga

SEQ ID NO: 32 - protein, 980 aa, Saccharomyces cerevisiae
MSLEGNTLGKGAKSFPLYIAVNQYSKRMEDELNMKPGDKIKVITDDGEYNDGWYYGRNLRTKEEGLYPAVFTKRIAIEKPENLHKSPTQESGNSGVKYGNLNDSASNIGKVSSHQQENRYTSLKSTMSDIDKALEELRSGSVEQEVSKSPTRVPEVSTPQLQDEQTLIQEKTRNEENTTHDSLFSSTADLNLSSESLKNISKSNISTKSLEPSSESVRQLDLKMAKSWSPEEVTDYFSLVGFDQSTCNKFKEHQVSGKILLELELEHLKELEINSFGIRFQIFKEIRNIKSAIDSSSNKLDADYSTFAFENQAAQLMPAATVNRDEIQQQISSKCNKLSSESSDRKSSSVTTELQRPSSVVVNPNFKLHDPAEQILDMTEVPNLFADKDIFESPGRAPKPPSYPSPVQPPQSPSFNNRYTNNNARFPPQTTYPPKNKNPTVYSNGLIPNSSTSSDNSTGKFKFPAMNGHDSNSRKTTLTSATIPSINTVNTDESLPAISNISSNATSHHPNRNSVVYNNHKRTESGSSFVDLFNRISMLSPVKSSFDEEETKQPSKASRAVFDSARRKSSYGHSRDASLSEMKKHRRNSSILSFFSSKSQSNPTSPTKQTFTIDPAKMTSHSRSQSNSYSHARSQSYSHSRKHSLVTSPLKTSLSPINSKSNIALAHSETPTSSNNKEAVSQPSEGKHKHKHKHKSKHKHKNSSSKDGSSEEKSKKKLFSSTKESFVGSKEFKRSPSELTQKSTKSILPRSNAKKQQTSAFTEGIRSITAKESMQTADCSGWMSKKGTGAMGTWKQRFFTLHGTRLSYFTNTNDEKERGLIDITAHRVLPASDDDRLISLYAASLGKGKYCFKLVPPQPGSKKGLTFTEPRVHYFAVENKSEMKAWLSAIIKATIDIDTSVPVISSYATPTIPLSKAQTLLEEARLQTQLRDAEEEEGRDQFGWDDTQNKRNSNYPIEQDQFETSDYLESSAFEYPGGRL

SEQ ID NO: 33 - DNA, 893 bp, Saccharomyces cerevisiae
tactggagaagagtgtttgattccagcagaaggtaatacgcacctttctcatctatttgcagaatcgttttattaaaatacttttaaagaatttagattttgataattagttcattctcttttacaaagataatcaccaaacagggacaatacactgaacgataaaagtatgtgacatatagaatgctagaatgaatagcctagactgcattgttatgagagcaacgtttgatatttgtggcgattggaacaaacatagtacatgccaaaatgagatgaaatgtccaatttgaactgattaacatacacgcgcaagctcgtatttgtttactggtacacctagagttagccgatcaaagagacagtggcagatatatgggaaaattttctccggaagattgcatgcgagagtctcataaccagtcatttcccaagatacaattctcggagctgttatactaacaaacttttaattttcatttttttttttttttgattagatggcctccttacctcacccaaagattgtcaagaagcacaccaagaagttcaagcgtcatcactctgaccgttaccacagagttgctgaaaactggagaaagcaaaagggtattgactctgttgttagaagaagattcagaggtaacatctctcaaccaaagatcggttacggttctaacaagaagaccaagtttttgtcaccatctggtcacaagactttcttagtcgctaacgttaaggatttggaaaccttgaccatgcacaccaagacttacgccgctgaaattgctcacaacatctccgctaagaacagagttgtcattttggctagagctaaggctttgggtatcaaggtcaccaacccaaagggtcgtttggctttggaagcttaa

SEQ ID NO: 34 - protein, 130 aa, Saccharomyces cerevisiae
MASLPHPKIVKKHTKKFKRHHSDRYHRVAENWRKQKGIDSVVRRRFRGNISQPKIGYGSNKKTKFLSPSGHKTFLVANVKDLETLTMHTKTYAAEIAHNISAKNRVVILARAKALGIKVTNPKGRLALEA

SEQ ID NO: 35 - DNA, 836 bp, Saccharomyces cerevisiae
catcgcttgatttccggcctgcaaaaataaagtagtcggtacgtactttcgttttcaatttccatggtgcacagtatcttaactatctgcttagtcgaggagaaccaggattctgttcgttgctcagccgcttcgtggatattctcttggatactttaaacatggacctacgttccgctctcgaaaagaccaatataataaaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatataccctaacactaccctaaccctaccctatttcaacccttccaacctgtctctcaacttaccctcacattaccctacctctccacttgttaccctgtcccattcaaccataccactcccaaccaccatccatccctctacttactaccaccaatcaaccgtccaccataaccgttaccctccaattagccatattcaacttcactaccacttaccctgccattactctaccatccaccatctgctactcaccatactgttgttctaccctccatattga

SEQ ID NO: 36 - protein, 111 aa, Saccharomyces cerevisiae
MSLRPCLTPSSMQYSDIYIYPNTTLTLPYFNPSNLSLNLPSHYPTSPLVTLSHSTIPLPTTIHPSTYYHQSTVHHNRYPPISHIQLHYHLPCHYSTIHHLLLTILLFYPPY

SEQ ID NO: 37 - DNA, 812 bp, Saccharomyces cerevisiae
gaaaaatcgcccgggcatttcgttatcttccacgctaaaagtcaaggagagatattacggccaggatcgcaaaggtgcagagcaaggaaatgtgagaaattgtgagaacgataatgtatgggacaatgcgaaaatgtgagaacgagagcaaaaatcttttttgtatctccccgccgaatttggaaaccgcgttctgaaaacttcgcatcttcacatagtaaaactgttccgagcgcttctccccataatggttagtggtaaaaaccgaagttgtttactttagcaaatgcccgcgaatacggtggtaaattgccacccccccttccccattcattgggtaaagaccaatttgatggataaattggttgtggaaaaggtctaattctttttcctataaataccgagatattttttctatatgatggtttccgtcgcattattgtactctatagtactaaagcaacaaacaaaaacaagcaacaaatataatatagtaaaatatgtccggtagaggtaaaggtggtaaaggtctaggtaaaggtggtgccaagcgtcacagaaagattctaagagataacatccaaggtattactaagccagctatcagaagattagctagaagaggtggtgtcaagcgtatttctggtttgatctacgaagaagtcagagctgtcttgaaatccttcttggaatccgtcatcagagactctgttacctacaccgaacacgccaagagaaagactgttacttctttggatgttgtttatgctttgaagagacaaggtagaaccttatacggtttcggtggttaa

SEQ ID NO: 38 - protein, 103 aa, Saccharomyces cerevisiae
MSGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 39 - DNA, 2600 bp, Saccharomyces cerevisiae
atcgcttcgctgattaattaccccagaaataaggctaaaaaactaatcgcattatcatcctatggttgttaatttgattcgttaatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtaatgccatgtaatatgattattaaacttctttgcgtccatccaaaaaaaaagtaagaatttttgaaaattcaatataaatgacagctcagttacaaagtgaaagtacttctaaaattgttttggttacaggtggtgctggatacattggttcacacactgtggtagagctaattgagaatggatatgactgtgttgttgctgataacctgtcgaattcaacttatgattctgtagccaggttagaggtcttgaccaagcatcacattcccttctatgaggttgatttgtgtgaccgaaaaggtctggaaaaggttttcaaagaatataaaattgattcggtaattcactttgctggtttaaaggctgtaggtgaatctacacaaatcccgctgagatactatcacaataacattttgggaactgtcgttttattagagttaatgcaacaatacaacgtttccaaatttgttttttcatcttctgctactgtctatggtgatgctacgagattcccaaatatgattcctatcccagaagaatgtcccttagggcctactaatccgtatggtcatacgaaatacgccattgagaatatcttgaatgatctttacaatagcgacaaaaaaagttggaagtttgctatcttgcgttattttaacccaattggcgcacatccctctggattaatcggagaagatccgctaggtataccaaacaatttgttgccatatatggctcaagtagctgttggtaggcgcgagaagctttacatcttcggagacgattatgattccagagatggtaccccgatcagggattatatccacgtagttgatctagcaaaaggtcatattgcagccctgcaatacctagaggcctacaatgaaaatgaaggtttgtgtcgtgagtggaacttgggttccggtaaaggttctacagtttttgaagtttatcatgcattctgcaaagcttctggtattgatcttccatacaaagttacgggcagaagagcaggtgatgttttgaacttgacggctaaaccagatagggccaaacgcgaactgaaatggcagaccgagttgcaggttgaagactcctgcaaggatttatggaaatggactactgagaatccttttggttaccagttaaggggtgtcgaggccagattttccgctgaagatatgcgttatgacgcaagatttgtgactattggtgccggcaccagatttcaagccacgtttgccaatttgggcgccagcattgttgacctgaaagtgaacggacaatcagttgttcttggctatgaaaatgaggaagggtatttgaatcctgatagtgcttatataggcgccacgatcggcaggtatgctaatcgtatttcgaagggtaagtttagtttatgcaacaaagactatcagttaaccgttaataacggcgttaatgcgaatcatagtagtatcggttctttccacagaaaaagatttttgggacccatcattcaaaatccttcaaaggatgtttttaccgccgagtacatgctgatagataatgagaaggacaccgaatttccaggtgatctattggtaaccatacagtatactgtgaacgttgcccaaaaaagtttggaaatggtatataaaggtaaattgactgctggtgaagcgacgccaataaatttaacaaatcatagttatttcaatctgaacaagccatatggagacactattgagggtacggagattatggtgcgttcaaaaaaatctgttgatgtcgacaaaaacatgattcctacgggtaatatcgtcgatagagaaattgctacctttaactctacaaagccaacggtcttaggccccaaaaatccccagtttgattgttgttttgtggtggatgaaaatgctaagccaagtcaaatcaatactctaaacaatgaattgacgcttattgtcaaggcttttcatcccgattccaatattacattagaagttttaagtacagagccaacttatcaattttataccggtgatttcttgtctgctggttacgaagcaagacaaggttttgcaattgagcctggtagatacattgatgctatcaatcaagagaactggaaagattgtgtaaccttgaaaaacggtgaaacttacgggtccaagattgtctacagattttcctga

SEQ ID NO: 40 - protein, 699 aa, Saccharomyces cerevisiae
MTAQLQSESTSKIVLVTGGAGYIGSHTVVELIENGYDCVVADNLSNSTYDSVARLEVLTKHHIPFYEVDLCDRKGLEKVFKEYKIDSVIHFAGLKAVGESTQIPLRYYHNNILGTVVLLELMQQYNVSKFVFSSSATVYGDATRFPNMIPIPEECPLGPTNPYGHTKYAIENILNDLYNSDKKSWKFAILRYFNPIGAHPSGLIGEDPLGIPNNLLPYMAQVAVGRREKLYIFGDDYDSRDGTPIRDYIHVVDLAKGHIAALQYLEAYNENEGLCREWNLGSGKGSTVFEVYHAFCKASGIDLPYKVTGRRAGDVLNLTAKPDRAKRELKWQTELQVEDSCKDLWKWTTENPFGYQLRGVEARFSAEDMRYDARFVTIGAGTRFQATFANLGASIVDLKVNGQSVVLGYENEEGYLNPDSAYIGATIGRYANRISKGKFSLCNKDYQLTVNNGVNANHSSIGSFHRKRFLGPIIQNPSKDVFTAEYMLIDNEKDTEFPGDLLVTIQYTVNVAQKSLEMVYKGKLTAGEATPINLTNHSYFNLNKPYGDTIEGTEIMVRSKKSVDVDKNMIPTGNIVDREIATFNSTKPTVLGPKNPQFDCCFVVDENAKPSQINTLNNELTLIVKAFHPDSNITLEVLSTEPTYQFYTGDFLSAGYEARQGFAIEPGRYIDAINQENWKDCVTLKNGETYGSKIVYRFS

SEQ ID NO: 41 - DNA, 1436 bp, Saccharomyces cerevisiae
ttgagattttccaagtagtaactcatctttctgagtgtgctatcaaatacatactaaggagaataaactcttgttattacgtattcttcatccttatgggtagagagcgcactgttttagtacattttctagacgtcgaaacgtagagcaattgtcgataaaacaaaaaaaaagtaagaagatatatgaataggacgtgtcgctagaactagtaagtatatgatggagatataataagtgaattattcgatatttaatgaacgttctcatttatttggaagaaatgtttatcacgtgatggagaaccaatgagcggcgagtaactacgcgaggaacccggaccgcaataacgattaaagaaggcccggaagggagatgcttaaatgattatcactcagttaaaaaagacaaataagaaactattgagactgaaccgttttggttaatttcaggtggaaacaattgaagacgagcagtaaacattattttatttagtagtcatgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatga

SEQ ID NO: 42 - protein, 311 aa, Saccharomyces cerevisiae
MLSRIVSNNATRSVMCHQAQVGILYKTNPVRTYATLKEVEMRLKSIKNIEKITKTMKIVASTRLSKAEKAKISAKKMDEAEQLFYKNAETKNLDVEATETGAPKELIVAITSDKGLCGSIHSQLAKAVRRHLNDQPNADIVTIGDKIKMQLLRTHPNNIKLSINGIGKDAPTFQESALIADKLLSVMKAGTYPKISIFYNDPVSSLSFEPSEKPIFNAKTIEQSPSFGKFEIDTDANVPRDLFEYTLANQMLTAMAQGYAAEISARRNAMDNASKNAGDMINRYSILYNRTRQAVITNELVDIITGASSLG

SEQ ID NO: 43 - DNA, 1517 bp, Saccharomyces cerevisiae
aagtacgatatggtataactgtaacattgaaggactgaaggactgaaggactgaaggactatagtcaagggccaatggggaaggtcccttccaggccatttgcccgatagtttgtccttctcttgcttttccgacggcccgattgcatgtggcggggcagcactggataaaaaaacgtggggggagtgattaaatttatacgcttattgtgtcaacacggaaaccttatagttatcattactaacatcgcaacaagctgcttttttactcgtttttagccacaccataccccctttaattaactaataatgcataaaatagttattgcttcttgagttgcagcttcttcctggacgtactgttatatatggcatgtcttcgcatgtccgtcaaatttagcgttgtctcgaaacttaggctgtcgttcttgctgtctgtcttctgataaaataatatattggaataagaaaaaaaaaataggaacaagaaagtgtgtgagaatgactttgagtaattgcgactctttggataacttattccaggaccctccagaggaagaagaaagtagtaaattcgttgaggcggtcagaactttgatgaatagaaacgatatgggatatcctcccgccgctgcaaatggtacgtattgcttaaaaaaaatcaagtctttgaatgccaaacagtggaaaataaacaagaaaagaatgtgcatgttgccagcagtaaagaagaaaaatttcgactttcacgagcaaagaagtttaatcttgaatttaaatttatggaaattcatcaagtttatcaattgtagtagtaaaaacaattacaataaaaataataagcatgtgagaagctcgaacaacactgtaaaaaatgaaaatgttttaccgttacaaaaacacaagaaagtggacaatgatcaaagattggagaaccttttttggagaagctggtttaaggcacgcaaaaggagagatataatgggcaagccacgagagaggcatatcaaatttaacgataacgttgaacagtgtattataactgatgagcatttcatacaaaggcttccttctacacggttgaattcgactgatgaacagcgcccttgttcaaagtctgaactagatccctgtattggcaacgcagcaagtaagcgaagtttctatgattataacagcgtttacgtcgcgagtgacgcaattattacgactgccgctgccactgccattatcagtagtaatagtggagactatcagcgtgggcacgatgttcgcgatgttccaagaaatgttttgttacaggcaggagaaacagatttcagtagtgtgcttcgggttgactccgatctcaagttatccaacataagtcatcattcccccgtaaaaccttcgtcaacttcaagtcattcgaccttcattttcgagtcggaaactgacactgatactgatactgacgctgaaacagaaaatgacattgacgcttacatagacaccagtatacccaacctgctcctataa

SEQ ID NO: 44 - protein, 338 aa, Saccharomyces cerevisiae
MTLSNCDSLDNLFQDPPEEEESSKFVEAVRTLMNRNDMGYPPAAANGTYCLKKIKSLNAKQWKINKKRMCMLPAVKKKNFDFHEQRSLILNLNLWKFIKFINCSSKNNYNKNNKHVRSSNNTVKNENVLPLQKHKKVDNDQRLENLFWRSWFKARKRRDIMGKPRERHIKFNDNVEQCIITDEHFIQRLPSTRLNSTDEQRPCSKSELDPCIGNAASKRSFYDYNSVYVASDAIITTAAATAIISSNSGDYQRGHDVRDVPRNVLLQAGETDFSSVLRVDSDLKLSNISHHSPVKPSSTSSHSTFIFESETDTDTDTDAETENDIDAYIDTSIPNLLL

SEQ ID NO: 45 - DNA, 848 bp, Saccharomyces cerevisiae
ccattttggtgaccaactctcctacccgaattactgtgatgatatatactcttcgttttctagtaatggcttcattttgcctaagttggtcaaaattgttgtgggcggcttttgtttgcaccgaggagcgctcagttcgttataataccagttttgccactcctaaactactaaagaaataatagaaagatatattcatcaaacataatcacaatcaaaaaaatgtctacatatgaaggtatgtaatgatatattatgaagtaagttccccaaagccaattaactaaccgaattttaatctgcactcatcattagattagaggaacatggaatacaacaaaactcaagggattaccaagaagtaggaggaacttcacaggaggagcagagaagacaggtcaagatcccaactgcaaggtctatttcaaaactttggtaacaccagtggtgagggtgatgcacattcagattcaacactacttttacgattattatcgcaaatgcttccagaatcattacaggaagaatggttgcaagaaatggataaaggcaagagtgcgggctgtcctgatacttttgcagcctctttaccacgaatcaataaaaaaaagctcaaagcaactgacaactgctccatttgttacactaattatttagaagatgagtaccccttagtagttgaattacctcattgccatcataagttcgacttagagtgtttgtctgtctggctatctcgaagtacaacatgtccattatgcagagataatgttatgggccaccgaatcattaatgagattgatacaactgaagcagaactggaagaagattggggtatgtacggttaa

SEQ ID NO: 46 - protein, 115 aa, Saccharomyces cerevisiae
MLPESLQEEWLQEMDKGKSAGCPDTFAASLPRINKKKLKATDNCSICYTNYLEDEYPLVVELPHCHHKFDLECLSVWLSRSTTCPLCRDNVMGHRIINEIDTTEAELEEDWGMYG

SEQ ID NO: 47 - DNA, 800 bp, Saccharomyces cerevisiae
ttttttaggtggcgcggcaactataaagtacagcaagtgaggttgaggcaatactgggagtttacactatgggagacagctcctaacaccaagcagaaaaacgactttttcgcaaagtatgtaaggcgctgggtgagcccagcggacgaggatgggcttaataagaacgtacagtttagcacagctagaacaggatacagctaagggcaactctgcttttcgggagaagttaaagaggggtagacaatgatggtaatcttataaaccggctacaatgaaggttgtagcagcaaggaagatgatattttaatacggttcaggtgaaatgaaatagccgcccataacggcatgctcaagttgtaagtcaggactctagctttctactgtagtatcctctaaaggactgctgttctgtgcacccccttcctttgtttatcatagcgcacgacaagagtactaactaattaacttagaacattaacatatataaaactagcgctatggccgcaactaaagaagcaaagcaaccaaaggaaccaaagaagaggaccaccaggagaaagaaggatcctaacgcccctaagaggcggttgtcagcttatatgttctttgctaatgaaaacagagacattgtccgttccgagaatcctgacgtaacttttggccaagtaggcagaatattgggtgagaggtggaaggccttaactgctgaagaaaagcaaccctatgaatctaaggctcaagcagacaagaagagatacgaatctgaaaaggaattgtacaatgctacacgtgcttga

SEQ ID NO: 48 - protein, 99 aa, Saccharomyces cerevisiae
MAATKEAKQPKEPKKRTTRRKKDPNAPKRRLSAYMFFANENRDIVRSENPDVTFGQVGRILGERWKALTAEEKQPYESKAQADKKRYESEKELYNATRA

SEQ ID NO: 49 - DNA, 1373 bp, Saccharomyces cerevisiae
aatgatgaaatgttatccccagggtccattaagtcatccagaaaacagatagatggattgaaggccgtaggtttggattttgtctacaaattggacgagtttatcaaaaagaacagtgataaaattcgctaaacaagatcacagaaaataaacctcacttcaatatatatgatgtgtaggtagggtatatacttataccactgctgtcgacagtgtactaacctatttcctattttgtaggtaagcttttcagctactggttggtcaagttgggccctattaaggttgtaatcagcttattcgtttgaaatgatatacctcttggactggaatcttctggaagttttttggaggttagaaaagaggaaggcatctcgcgctgacagaaatttgcttataaaccagcgattggctatatctaaaagagcactcatcgtcagtcagaaagccattacctttcaacgaaagagtaaaatagaaaaaaaaacacatacataactatggaaaagctattacagtggtctattgcgaattctcaaggggacaaagaagctatggctagggccggccaacctgatcctaaattgctacagcagttattcggtggtggtggtcctgacgatccaaccttaatgaaagaatccatggctgttattatgaatccggaggttgacttagaaacaaaactcgttgcatttgacaactttgaaatgttgattgagaacttagataatgctaataatatcgaaaatttaaaactgtgggagccattgttggatgttcttgttcagacgaaggatgaagaactacgtgctgctgctttatccattattggaacggctgtgcaaaacaacttggattcgcaaaataatttcatgaaatacgacaatggtctgcgaagccttatcgaaatagctagtgacaagacaaagccactcgacgtgagaacaaaagctttttacgcactatctaatctaataagaaaccacaaagatatctcagaaaagtttttcaaattaaatgggctcgactgcatagcacctgtattaagtgataacaccgccaaaccaaaactgaaaatgagagccattgccttattgaccgcatatttgtcatctgttaagattgatgaaaatataatcagtgtgctgagaaaggatggagtaattgaaagtacgattgagtgcttgtctgacgagagtaacttgaacatcatagatagagttctgtcttttctctctcacctgatatcttccggaataaaatttaatgaacaggaattgcacaaattgaacgaaggttacaaacatatcgagcctctaaaggacagacttaatgaagacgattatttagccgtaaagtatgtattatga

SEQ ID NO: 50 - protein, 290 aa, Saccharomyces cerevisiae
MEKLLQWSIANSQGDKEAMARAGQPDPKLLQQLFGGGGPDDPTLMKESMAVIMNPEVDLETKLVAFDNFEMLIENLDNANNIENLKLWEPLLDVLVQTKDEELRAAALSIIGTAVQNNLDSQNNFMKYDNGLRSLIEIASDKTKPLDVRTKAFYALSNLIRNHKDISEKFFKLNGLDCIAPVLSDNTAKPKLKMRAIALLTAYLSSVKIDENIISVLRKDGVIESTIECLSDESNLNIIDRVLSFLSHLISSGIKFNEQELHKLNEGYKHIEPLKDRLNEDDYLAVKYVL

SEQ ID NO: 51 - DNA, 3401 bp, Saccharomyces cerevisiae
gggtgccgtatcggctctaattattttatctctctattttctttcttttctctgcgctactcctttctcgatcgttgctactcccgtcgctagccactggtctcccgcgtactgtactccatctttttttggcgtttttcccctatccaactcgaacaaggtttgtttaaatttattttatttttcttttcttcggtcggtcgttcttttcccttccgattatcaaagcaaaagcgcatttttttctttgtctttttgttttttgtttcctgttctctgtttttttacaaaccacgtcaggagttcaattgagagaactagaatcaacaaagccaaatacgacaacgtcactagtctttgaaccagaggcgtattcccgttacctcttttcccatatttctgtttttctttttcactgctataagcctttagactagtactacaactacaacagcaacaacaacaaacaaaacacgactggaaaaaaaaaattaggaaaaatgaatccgggcggtgaacaaacaataatggaacaacccgctcaacagcaacaacaacagcaacaacaacagcagcaacagcaacagcaggcagcagttcctcagcagccactcgacccattaacacaatcaactgcggaaacttggctctccattgcttctttggcagaaacccttggtgatggcgacagggccgcaatggcatatgacgccactttacagttcaatccctcatctgcaaaggctttaacatctttggctcacttgtaccgttccagagacatgttccaaagagctgcagaattatatgaaagagcacttttggtaaatcccgaactatcagatgtgtgggctactttaggtcattgttatctgatgctggatgatctgcaaagagcttacaatgcctatcaacaggctctctaccacctcagtaatcccaacgtaccgaaattatggcatggaatcggcattctttatgacagatatggttcgctcgactatgccgaagaagcttttgccaaagttttggaattggaccctcattttgaaaaggcaaacgaaatttacttcagactaggtattatttataaacatcagggtaaatggtctcaagctttggaatgcttcagatacattctccctcaacctcctgctcccttgcaggagtgggacatatggtttcagttgggtagtgttttggagagtatgggagagtggcaaggtgcgaaggaagcctacgagcatgtcttggctcaaaatcaacatcatgccaaagtattacaacaattaggttgtctttacggtatgagtaacgtacaattttatgaccctcaaaaggcattggattatcttctaaagtcgttagaagcagatccctccgatgccactacatggtaccatctcggtagagtgcatatgattagaacagattatactgccgcatatgatgctttccaacaagctgttaatagagattcaagaaaccctatcttttggtgctcaatcggtgttttatattaccaaatttctcaatacagagacgccttagacgcgtacacaagagccataagattaaatccttatattagtgaagtttggtacgatctaggtactctttacgaaacttgtaacaaccaattatctgacgcccttgatgcgtataagcaagctgcaagactggacgtaaataatgttcacataagagaaagattagaagctttaacaaagcagttagaaaacccaggcaatataaacaaatcgaacggtgcgccaacgaatgcctctcctgccccacctcctgtgattttacaacctaccttacaacctaatgatcaaggaaatcctttgaacactagaatttcagcccaatctgccaatgctactgcttcaatggtacaacaacagcatcctgctcaacaaacgcctattaactcttctgcaacaatgtacagtaatggagcttcccctcaattacaagctcaagctcaagctcaagctcaagcacaagctcaagcacaagcacaagctcaagcacaagcacaagcacaagcgcaagcacaagcacaagcacaggcgcaagcacaggcacaagcacaagcacaagcacatgcacaagcgcaagcacaagcacaagcacaggcacaagcacaagcacaggcgcaggcacaacaacaacaacaacaacagcaacaacaacaacaacaacaacaacaacaacaacaacaacaacaacaacaacaacaacaacagcagcagcaattacagcccctaccaagacaacagctgcagcaaaagggagtttctgtgcaaatgttaaatcctcaacaagggcaaccatatatcacacagccaacagtcatacaagctcaccaactgcaaccattttctacacaagctatggaacatccgcaaagctctcaactgccacctcaacagcaacaactacaatctgttcaacatccacaacaacttcaaggccagcctcaagcccaagctccccaacctttaatccagcataacgtggaacagaacgttttacctcaaaagagatacatggaaggtgcaatccacactttagtagatgccgccgtatccagtagcacccacacagagaataacacaaagtctcctcgtcaaccaacccatgccattccaacgcaagctcccgcaacaggaataacgaacgctgaaccacaggtaaagaagcaaaagttgaactctccaaattcaaacatcaacaaattagtaaatactgctacttccattgaagaaaatgcaaaatctgaggtgagcaaccaatcgccagcagtagtggagtctaataccaataatacttcacaagaagaaaaacctgtaaaagcaaactcaataccttcagtaattggcgcacaggaacctccacaggaagctagtcctgctgaagaagctaccaaagcagcttctgtttctccttctacaaaaccgcttaatacggaaccagagtcatctagtgtccaaccaactgtatcatcagaaagttcaacaacaaaagcaaatgaccaaagcactgctgagaccatagaactttctactgctactgttcctgcagaagcaagccctgtagaagacgaagtaagacagcattctaaagaggaaaacggcacaactgaagcatctgcaccttctactgaagaggcggagccagcagcttccagagatgctgaaaaacaacaagatgaaaccgctgctacaacgataactgtaatcaaacctactttggaaacaatggaaacagtgaaagaggaggccaaaatgcgtgaggaagagcaaacatctcaagaaaaatccccacaggagaacacacttccaagagaaaatgtagtaaggcaagtggaagaagatgaaaactacgacgactaa

SEQ ID NO: 52 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAQAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 53 - DNA, 2984 bp, Saccharomyces cerevisiae
aacttacgacagagttgtaatgaatgctactgatgtctgctctactgccatccgctgtcctttcatgcataaaagctccattctttatttatctcataccacgagaaaaaaaaatcacctgacatatttttataacccgccttttagaccctaaaacagatctcagggctcgagtactgttttatctgaaaattcttcgagccctcgttttgcactgagctaaaccaaaagaaaaataaacaatcacaaatggaacccgaaacagcacgctgcgcagtgtttttatatttttttgaaacaaatggctttatacaatgtgtatgtgtgatagaaaaaatggtatatttcgagtgacttgtgatcctattcccaagccctataggagctatttcaaattgcgtgtgtgaaagcgtgtgtgtgtgtgtgtgtgtggaattgtgcggacgttcctcttcttttatacatataatttttatatatacaaagggttcagtttgcatatgcatagcaacgtatttgttggtgtcaaaccaggctttaatcataaacagcacagcaaaaagtcacgtttcctagaaaatgtctctagtcattcaccagaactgcctagtaactatgattacgttttgcttcctataacaacgccaagatataaggaaatagttgggcaagttttcaaagatttccaaagacaatccatacagaactggaaaccgcttcaaattcctgaaccgcagttgcaggatatctgtatacccccgttcaacgtcaagaagctagacaatgacgatacgccgtcttacatagggctgttatcctcttggctggagctggagagtcgcgatccaaatgtaagagatcttggcttaaaggtccttctaaacgaatgtaagtacgcgaggtttgttggaatcaataagctaatattggcgcctccacgggacctgtccaacctgcaattgtatggacagatgatttacaggctcctgcaaaatcgcatcgtctttgctgcgcctgcgttaaccatatccatttctctgccactttacgaagacagcgatccattggccacttgggaactgtggaataccgtgcggaaacaatgcgaatatcatccctctttgactatctctttggctttgccaagaaccaggactccttcgtatgtgctgaatagatggttagccgaacccgtctcgtgtcttttggtatcttcatccatctttgccagtaatcagtacgattatcccgttttacacaagtttaaccagaatttgattttaaagttccaaaaggttaatggagattcacaaattttgggtaatgaattatgcgtgatattgcatgggatggagaaatatgccaataatgttaagggcggagaatctgcctatttggaatatataaactacttattgaaaaagggcgacaaagtattaaattccaatagtaatcaccaatttttgctccaagaggactctcggataatgccgcctctgaaacctcattcagataatttattaaattccacatatttgacttttgaaaaagatttggtgaagtacgatctttacgaatctgccatattagaggcgcttcaagatcttgctcctcgagcgagtgccaagagaccgttggtgatcctagtagccggtgcgggaagaggacctttagtggatcgaacttttaagataatatcaatgttgtttatggatagtaaggtttctataattgccattgaaaaaaatccacaggcatatctgtacttgcaaaaaagaaatttcgactgttgggataatagagtgaaattaatcaaggaggatatgaccaaatggcaaatcaacgagccgtcggaaaagcgtattcagatagatctgtgcataagtgaactgctgggttcgttcggttgcaatgaattatcaccagaatgtctctggtctattgaaaaatatcattcccacaatgacacaattttcataccgaggtcatactcttcatacatagcacccatttcgtcaccattattctaccaaaaactctcacaaacaaatcgctctttggaggcgccctggatagtccatagagtgccatactgtatattatcctcaagggtaaatgaagtgtggcggttcgagcatcccatggcccaaaaagatactgtccaagacgaagatgattttacagttgaattttctcaaagttcattaaatgagttcaagataaagcaccgcggcgaaatccatggctttatcggattcttctcggcaaacttatataacaatatattcttgtcaactttgcccaatgacagcacagtccgtttaaaatttagcgaagaaacgttgatgaataccagacgagaagaaaatctaatcaagaaatgtgaccatacaccaaatatgacctcgtggtctccaattatctttcctttgaagcaaccaatatcctttatagatgactccgaactttctgtgctgatgtctcggatacactccgatacagaacaaaaagtttggtatgaatggtctttggagagtttcatataccttatgttgtcaaattacacttcggcggtaactgctgcaagcatgactattccgaggtctatagttacagatgacactaaaactttagcccataatcgacattattcagcgactaccaatcaaaagctagataatcaaattgatcttgaccaagacattgaaaacgaagaagaacagggattcctatccaatctagaaactggttggcaaagcgtacaagatattcacggactcagcgaaaccgccaaaccggaccatttagattctatcaataagcctatgtttgatctcaaatctactaaagcgcttgaaccctctaacgaattgccaaggcacgaagacctcgaggaagatgttccagaagttcatgtcagagtcaagactagtgtttccacgctacataatgtctgtggcagagccttttccctgcctctgtga

SEQ ID NO: 54 - protein, 827 aa, Saccharomyces cerevisiae
MHSNVFVGVKPGFNHKQHSKKSRFLENVSSHSPELPSNYDYVLLPITTPRYKEIVGQVFKDFQRQSIQNWKPLQIPEPQLQDICIPPFNVKKLDNDDTPSYIGLLSSWLELESRDPNVRDLGLKVLLNECKYARFVGINKLILAPPRDLSNLQLYGQMIYRLLQNRIVFAAPALTISISLPLYEDSDPLATWELWNTVRKQCEYHPSLTISLALPRTRTPSYVLNRWLAEPVSCLLVSSSIFASNQYDYPVLHKFNQNLILKFQKVNGDSQILGNELCVILHGMEKYANNVKGGESAYLEYINYLLKKGDKVLNSNSNHQFLLQEDSRIMPPLKPHSDNLLNSTYLTFEKDLVKYDLYESAILEALQDLAPRASAKRPLVILVAGAGRGPLVDRTFKIISMLFMDSKVSIIAIEKNPQAYLYLQKRNFDCWDNRVKLIKEDMTKWQINEPSEKRIQIDLCISELLGSFGCNELSPECLWSIEKYHSHNDTIFIPRSYSSYIAPISSPLFYQKLSQTNRSLEAPWIVHRVPYCILSSRVNEVWRFEHPMAQKDTVQDEDDFTVEFSQSSLNEFKIKHRGEIHGFIGFFSANLYNNIFLSTLPNDSTVRLKFSEETLMNTRREENLIKKCDHTPNMTSWSPIIFPLKQPISFIDDSELSVLMSRIHSDTEQKVWYEWSLESFIYLMLSNYTSAVTAASMTIPRSIVTDDTKTLAHNRHYSATTNQKLDNQIDLDQDIENEEEQGFLSNLETGWQSVQDIHGLSETAKPDHLDSINKPMFDLKSTKALEPSNELPRHEDLEEDVPEVHVRVKTSVSTLHNVCGRAFSLPL

SEQ ID NO: 55 - DNA, 2027 bp, Saccharomyces cerevisiae
ggaggagtcaagggcctggaaagtacggatcctgtagaaatatcactggcaattatactgagtttattgttggtgttgctattcatatttgagctggtattggacgaaagcaaggataatgagtttgtgtctactgactccaacaccctaggctggatttgatctttctccatcctttaattttaaccttttaattagtggttggatcaagttttcgagactattccaatctgtgacttgttggataaatagtttttgactcgtttagtataatccttttttctaaaagtgcttagagttctctaagatgttcttgtttacaatgtgagcgatttaggaaatttcctaaaaatggccgaggcggcgctagcattctacgaaaggtgagataacgcttcgttatcgaaaaatgtcaggggacaggggttatataagaacgaaaattgtcatcctgcattttttctttaaaacagctatacaaaaagtgataccgacatacaatgaagtatctaaacttagttttcgtgcttcagcttcttattagcatcaaatacgcctcattcggccgagccttttctctttttgaagatgataccacctttgccaatttggataaacagctaaagcttccacagaatacacagcaaacccttaaattggaccgtttgaatcacgatgatccgctgtttacaacttttatttcttctgtggacacagattacagtttgagacttagaacagtagatccttctaaactaggaattgacaccgtaaaacaatggtcgggttacatggactataaggattccaaacactttttttactggttttttgaaagtaggaacgatcctgctaacgacccaattattctttggttaaatggtggacctggttgttcctcgtttactgggttgctatttgaactaggcccctcatcaattggcgccgatatgaaaccaatccacaatccctattcttggaataataacgcttcaatgatcttcttagaacagccactcggagtcggcttttcctatggtgatgaaaaagtctcctctacaaaattagcaggcaaagatgcgtacattttcctggaattgttttttgaagcttttcctcatttacgctccaacgatttccacattgcaggcgaatcctatgcaggacattatatccctcaaattgcacatgagatcgttgtcaagaaccctgaaagaacgttcaatttaacttcagttatgattggtaatggtatcacagaccctttgattcaagcagattattatgaaccaatggcatgcgggaaagggggctatcaccctgttctctcatcagaagaatgtgagaaaatgagtaaagctgcaggtcgttgtcgtaggttgaacaagttatgttatgcttctaaatcaagtttaccatgcatagtcgccactgcttactgtgactctgcacttttggaaccgtacattaacacaggactcaacgtctatgacattagagggccctgtgaagataatagtactgatggtatgtgttatacaggtctccgctatgtcgaccagtatatgaattttcctgaagttcaagaaacgctagggtccgacgtgcataattattctggctgtgataatgacgtgttcaccggatttttgtttacgggcgatggaagtaaaccatttcaacaatatattgctgaattattaaatcacaacattccggtattaatatatgcgggtgataaggattatatttgtaattggctgggaaaccatgcttggtccaatgagttggaatggatcaataaacgtaggtatcagagaaggatgttaagaccatgggtcagtaaagaaacaggtgaagagttgggacaagtcaagaactatggccctttcacctttttgagaatatacgatgccggtcatatggtgccctatgatcaaccggaggcaagtttggaaatggtcaacagttggatttccggtaatcgtgctttttcggatctttccaccttggaaaatgctagttag

SEQ ID NO: 56 - protein, 508 aa, Saccharomyces cerevisiae
MKYLNLVFVLQLLISIKYASFGRAFSLFEDDTTFANLDKQLKLPQNTQQTLKLDRLNHDDPLFTTFISSVDTDYSLRLRTVDPSKLGIDTVKQWSGYMDYKDSKHFFYWFFESRNDPANDPIILWLNGGPGCSSFTGLLFELGPSSIGADMKPIHNPYSWNNNASMIFLEQPLGVGFSYGDEKVSSTKLAGKDAYIFLELFFEAFPHLRSNDFHIAGESYAGHYIPQIAHEIVVKNPERTFNLTSVMIGNGITDPLIQADYYEPMACGKGGYHPVLSSEECEKMSKAAGRCRRLNKLCYASKSSLPCIVATAYCDSALLEPYINTGLNVYDIRGPCEDNSTDGMCYTGLRYVDQYMNFPEVQETLGSDVHNYSGCDNDVFTGFLFTGDGSKPFQQYIAELLNHNIPVLIYAGDKDYICNWLGNHAWSNELEWINKRRYQRRMLRPWVSKETGEELGQVKNYGPFTFLRIYDAGHMVPYDQPEASLEMVNSWISGNRAFSDLSTLENAS

SEQ ID NO: 57 - DNA, 1535 bp, Saccharomyces cerevisiae
ttcgcaaacatcaacttctccttaatcgaccaactgacaatgaacttcaggttctacgagagatctgccaatttccagaaggaaacaataggtgggttaagaatgatgctacaagataaggataactatatcaaaacactgatgcaacatttgaagaaaaaagagagtacaaagttgataaaagacagcaagaatggcgcctccaccttaacatcttaacaatttcgtttactgaaaatgctactagtatataatcattaagtatctaactatcactcaataaaaatattatagatcgcttaaaaactcgtttattgccgattataaatccaccaaaagccgctctacccttacctccgcctggaaaaattataatatataaagtgagcctcgtaatacaggggtaaaaaggaaagagggggatatcaagcatctggacttatttgcactatctccgccttcaattgataaaagcgtcttgattttaatcaactgctatcatgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcacattgatactgcttgggcctacgagacagagccattcgtaggtgaagccatcaaggagttattagaagatggatctatcaaaagggaggatcttttcataaccacaaaagtgtggccggttctatgggacgaagtggacagatcattgaatgaatctttgaaagctttaggcttggaatacgtcgacttgctcttgcaacattggccgctatgttttgaaaagattaaggaccctaaggggatcagcggactggtgaagactccggttgatgattctggaaaaacaatgtatgctgccgacggtgactatttagaaacttacaagcaattggaaaaaatttaccttgatcctaacgatcatcgtgtgagagccattggtgtctcaaatttttccattgagtatttggaacgtctcattaaggaatgcagagttaagccaacggtgaaccaagtggaaactcaccctcacttaccacaaatggaactaagaaagttctgctttatgcacgacattctgttaacagcatactcaccattaggttcccatggcgcaccaaacttgaaaatcccactagtgaaaaagcttgccgaaaagtacaatgtcacaggaaatgacttgctaatttcttaccatattagacaaggcactatcgtaattccgagatccttgaatccagttaggatttcctcgagtattgaattcgcatctttgacaaaggatgaattacaagagttgaacgacttcggtgaaaaatacccagtgagattcatcgatgagccatttgcagccatccttccagagtttactggtaacggaccaaacttggacaatttaaagtattaa

SEQ ID NO: 58 - protein, 344 aa, Saccharomyces cerevisiae
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 59 - DNA, 1501 bp, Saccharomyces cerevisiae
tggcttcttctttgcctgttttgcccagctggttgatacgggcacgtaactgatttaattcttggtccctttctagtgataaatctcgcagagagggcatactggttgtaaaaagtagtcgcaacaagtaagtcgtaaaaaagtagatgtaatggaaggctttgaaggaacggctagccagcttttctgtatcattcctagcctaattgacagcatcttgaccttctagtatggaaactttcaatttcagaaagcggtgttccccgctgcgacgatttaatccgtacatttacacatctgtacatttttcatattcgcaaaacaaaggttacttgaaaaaatcataaagttggcggcttcaggtggacgcgcttcactcatgtagcttaacattcaatcccattaagcattatgcataaatttcatgaagtttacttaataaaattgttcatttgcatagacaagaaagaaagcaacaagacaactaagactaagcaacaatgccaagtacgtattagactatatcgaagaggagggaaattcttcactctgactcgttgattttgaaagaggttcgggtcctcataaatatttgagaatatgaaattccataatagtataccttcattgagtagcacgacaacagcctgaattactatccatattatgaatatctttatttacactgaactcccgacacttcagttaaacagggatacattagagatcaaggtgatctaatagggaacatctctctcgtaacaatgggacagtattttattttccaaggcggatacctaattatgcgtttttaatcatatctctacaatatttatgagcacttacttgggcccttgcagacttttgttccgggaaaacttttgactaacaagaatccaattttacttttttttttttaggagctccaagaacttactctaagacttactctacaccaaagagaccttacgaatcttctcgtttggacgcagaattgaagttggccggtgaattcggtttgaagaacaagagagaaatttacagaatttctttccaattgtctaaaattcgtcgtgctgccagagacttgttaactagagacgaaaaggacccaaagagattgttcgaaggtaatgccttgatcagaagattggttagagttggtgtcttgtccgaagacaagaagaagttggattatgttttggctttgaaggttgaagatttcttggaaagaagattgcaaactcaagtctacaagttgggtttggccaagtctgtccaccacgccagagttttaatcactcaaagacacattgctgttggtaagcaaatcgtcaacatcccatctttcatggtcagattggactctgaaaagcacattgacttcgctccaacttctccattcggtggtgctagaccaggtagagttgctagaagaaacgctgctagaaaggctgaagcttccggtgaagctgctgaagaagccgaagacgaagaataa

SEQ ID NO: 60 - protein, 195 aa, Saccharomyces cerevisiae
MPRAPRTYSKTYSTPKRPYESSRLDAELKLAGEFGLKNKREIYRISFQLSKIRRAARDLLTRDEKDPKRLFEGNALIRRLVRVGVLSEDKKKLDYVLALKVEDFLERRLQTQVYKLGLAKSVHHARVLITQRHIAVGKQIVNIPSFMVRLDSEKHIDFAPTSPFGGARPGRVARRNAARKAEASGEAAEEAEDEE

SEQ ID NO: 61 - DNA, 1371 bp, Saccharomyces cerevisiae
aatccttattgtcagaaattgaagccgttaatatttaaaggctaattctccatgccatcttgcattcactttggtatatatctcttgacctcaatatatctcgataatataaatcgcaatattatacttgttagtctgacagttttacacctgtacatcttcaccatcaccacacccttttttactggaggcaaggatgagtttgaatatcgcctttttcccagccgctagaacatgctcagaaccgaggaaaagcaccgctgccaaacctcctttgatgtgttggcccaccgctactagtggccgtgctggaagcccaggcagcggtgggggccacaatacgagagctggaaaggtaaacggtctctgcgcctctgtgaaattttatcaccaatggagtgtcatgtctggtaaagataatatagaaagtagtgtgcaatttcaggcattaccgattgaactttggaataagagaaccaagacaaaaataactagcaacaatgggtaaatcgtatgtcatttaatcctatgaatctacagcacgaacgaatcatggtatctcaaaccgaacatatcgtcacagaaataaaaagatttaaagacgtgtctagtgtgaataaagcaaacatatcattagagcaaaatattgggcagataagatgatgctacactgattctgagaaaattacgtgacatgataggcttttaacgggctgtaagtcattagtttacagtcgttgctttgaaaattagttcaacattagaagtgtagtaattacaagccctttttccaaacattcggttatgtgctgggacgcatctcagaaactcgcaaaacaatagaatactaacatgatttcttataaatcttaattttgatttatttccttataatacagacacggttacagatctcgtactcgttacatgttccaacgtgacttcagaaagcatggtgccgtccatctttctacttacttgaaggtctacaaggttggtgacattgtcgacatcaaagccaatggttctatccaaaagggtatgccacacaagttttaccaaggtaagaccggtgttgtctacaacgttactaagtcttctgttggtgttatcatcaacaagatggtcggtaacagatatctagaaaaaagattaaacttaagagttgaacacatcaagcactccaagtgtagacaagaatttttggaaagagttaaggccaatgctgctaagcgtgctgaagctaaggctcaaggtgttgctgttcaattgaagagacaaccagctcaaccaagagaatcccgtatcgtttctactgaaggtaacgttcctcaaactttggccccagttccatacgaaactttcatctaa

SEQ ID NO: 62 - protein, 160 aa, Saccharomyces cerevisiae
MGKSHGYRSRTRYMFQRDFRKHGAVHLSTYLKVYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 63 - DNA, 3218 bp, Saccharomyces cerevisiae
gatacgatctatagtctctaaaaaggtaaaacaatcaagcgggccttttgacttcgaagtggaggctaagcaccaataattgagcttatttataactgagaaatacttatagacctctaaatctcttccaaccattgaatggtctaaataatcatcactactgctatcttcgagcaattgaggacatgtggtacgaacgcgggtccacaggtgcttgaaggagggagctgttgcacctaaaagatactggaaaataagtttgttctttgtatcagtgatatagaatgacaaatacatctattttggttgggttggtaaggtttacagcctctgttgttgcccaagtcctgttatcgccaactttaaataaatctcttcttgttctttgaccaaaaatttcatttttcgtcgcatttaaaagaaactgaaatttcaaacataaacaccaaaacaaagcatcatcaagggaacatatagtaaagaactacacaaaagcaacaatgaataatcagccgcagggtaccaacagcgttccaaatagtattggaaatatatttagcaacattggaactccatcttttaacatggcgcaaattccgcaacagctgtatcagagcctcacaccacaacaattgcagatgattcagcaacgacaccaacagttactgaggagtcgtctacaacaacaacaacaacaacaacaacaaacttcaccgccaccgcaaacgcatcaatctccaccccctcctccgcaacaatctcaacccattgctaatcaatcagcgacttctacccctcctcctcctccagcaccacacaacttacatccccaaattggtcaagtgcccttagctccagcgcctattaatttgcctccacaaattgctcagttacctttggctacacagcaacaagttttgaacaagttgaggcagcaggccatagcaaaaaataatccacaggttgtgaatgcaattactgttgcacaacaacaagtgcaacgccaaattgagcagcaaaagggacagcaaacggcacaaactcagctagaacagcagaggcaattgctggttcagcagcaacagcagcagcaacttagaaaccaaatacagcgacaacagcaacaacagtttaggcatcatgtgcaaatacaacagcagcaacaaaagcaacaacaacagcagcagcagcatcagcaacaacaacaacaacaacagcaacagcagcaacagcaacagcaacagcagcagcaacaacaacagcaacaacaacaacaacagcagcagcagcagcagcagcagcaaggacaaataccgcaatctcagcaagttcctcaagttagatccatgagtggacaacctcccaccaatgttcagcccactattggccaacttcctcaacttccaaaattaaacttacccaagtaccaaactattcaatacgatccaccagaaaccaagctaccatatccaacctattggtcagacaaaaaagcagatacggatactttgttgtacgaacaaattatccagcgtgataaaattaacaaatattcgctaataagagaaaccaatggttacgatccgtttagcatttatggatttagtaataaagagtatattagtagactgtggcatacactgaagtattatcaagatttgaagaacactagaatgaaatctatcacaagcacttctcagaagattccttcggcaagtatttggggaaatggttactcagggtatggtaatgggattacgaatacaactaccagagttattccacaagtagaagttggaaataggaagcattacctagaggataaattaaaagtctataaacaggccatgaatgagacatcggaacagttagttcccataagattggagttcgatcaagatcgtgacagattcttcctcagggacactttgttatggaacaaaaatgacaagcttattaaaattgaagactttgtggacgacatgttgcgagattaccgatttgaggacgctacgagagagcaacacattgatactatttgtcaatctatacaagagcagattcaggagtttcaaggaaatccatatatagagttgaatcaggaccgtctaggcggtgatgacttgagaattagaatcaagctggatattgtcgtgggacaaaaccagttaatcgatcaatttgagtgggagatctctaatagtgataactgtccagaagagtttgcagagtccatgtgtcaagaattagaactaccaggtgagtttgtgactgccattgctcactccataagagagcaagttcatatgtatcataaatcactggcactgttaggttacaattttgatggatcagcgatagaagatgatgacattagaagcagaatgctcccaacgattactcttgatgatgtttataggcctgcagcggaaagcaaaatttttactccaaacctattacagatttcagctgcagagttagagagattggataaagataaggacagagacacaagaaggaaaagaagacaaggtagatctaatagacgtggtatgctcgcattgtccggcacatctgcaagtaatacatctatgaacggcgttcacaacacagtagcagcaggaaatgcttcatcgttgccaccaggagagattttactgccagatattgcagatattccaagaactttcaggactccagtacctagcactttaatgcctggtggtgttgacgtaggcccttctgtggaatcgtacgaattgagaaacacaaccacttataaaagcaggccagatagacctaagccagtttcacctccttgttatattattgaccatattccgggtcattcgctactactttctattaaactgcctgggaaagttaatacaaaagaagagttcgcagcagcgcccaatgacacaagtagtggcaccaatgcaatgcttccgagtccagaatcgctgaaaactaagctgaatagtaacattcgcgctggtgtgacgataccttcaatcccaaacccgattgccaatcacactgttactaattcacccaatcccacactgcagccagtaatcccaggtggggcagctagtaaatcggtacctacacctagtcttcctatagcacctccagtagcaccacatgatagcgaagcgacattgttgactaatagcaataatggtagcagtaacaataacacacagaatacatag

SEQ ID NO: 64 - protein, 905 aa, Saccharomyces cerevisiae
MNNQPQGTNSVPNSIGNIFSNIGTPSFNMAQIPQQLYQSLTPQQLQMIQQRHQQLLRSRLQQQQQQQQQTSPPPQTHQSPPPPPQQSQPIANQSATSTPPPPPAPHNLHPQIGQVPLAPAPINLPPQIAQLPLATQQQVLNKLRQQAIAKNNPQVVNAITVAQQQVQRQIEQQKGQQTAQTQLEQQRQLLVQQQQQQQLRNQIQRQQQQQFRHHVQIQQQQQKQQQQQQQHQQQQQQQQQQQQQQQQQQQQQQQQQQQQQQQQQQQQQGQIPQSQQVPQVRSMSGQPPTNVQPTIGQLPQLPKLNLPKYQTIQYDPPETKLPYPTYWSDKKADTDTLLYEQIIQRDKINKYSLIRETNGYDPFSIYGFSNKEYISRLWHTLKYYQDLKNTRMKSITSTSQKIPSASIWGNGYSGYGNGITNTTTRVIPQVEVGNRKHYLEDKLKVYKQAMNETSEQLVPIRLEFDQDRDRFFLRDTLLWNKNDKLIKIEDFVDDMLRDYRFEDATREQHIDTICQSIQEQIQEFQGNPYIELNQDRLGGDDLRIRIKLDIVVGQNQLIDQFEWEISNSDNCPEEFAESMCQELELPGEFVTAIAHSIREQVHMYHKSLALLGYNFDGSAIEDDDIRSRMLPTITLDDVYRPAAESKIFTPNLLQISAAELERLDKDKDRDTRRKRRQGRSNRRGMLALSGTSASNTSMNGVHNTVAAGNASSLPPGEILLPDIADIPRTFRTPVPSTLMPGGVDVGPSVESYELRNTTTYKSRPDRPKPVSPPCYIIDHIPGHSLLLSIKLPGKVNTKEEFAAAPNDTSSGTNAMLPSPESLKTKLNSNIRAGVTIPSIPNPIANHTVTNSPNPTLQPVIPGGAASKSVPTPSLPIAPPVAPHDSEATLLTNSNNGSSNNNTQNT

SEQ ID NO: 65 - DNA, 833 bp, Saccharomyces cerevisiae
ccgaaagaaaccccatgttcttgttttgcctgcctccaatgctttatcactctctcacactgtcacaatcgtgttgtcttcatccttagaaaggataccacattgataaacaacatatataaagtttaactattaccttgatcactttacacgtcaaggtcaaaacagtttcatagttatcaccttgaagtatggctccatcatctataaaacatgaacttcatgcacaagtgagctgtctacagataacgagcagccgcaacggcgtttccagattgcgatgcttgttttctttatctactactgccttactaccccccttgcgcctcctgattcacgtgatgtgggaattttgtcttgaaaggagtaaatatataaaataaatgaaaagtttatataatataaaaagggactttagcataaaataaagaacttcgtgcagtacttatacgagcattcgcataattatacaaatagacaaaacctcagaaggaaaaaaaatggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaa

SEQ ID NO: 66 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 67 - DNA, 1751 bp, Saccharomyces cerevisiae
tgcacatgttgagtatgcgtattgggcattttcctattctgagaaggagtatgaaataattgccgagggttcagaatgctcttttagaaataaaaatgaatgtaaatagttggaatgtatctttaagtagacaaatgcaggtaagttttagtggcctttgcggattaacagtatgctcttagtgcaaaacacgaaaagagctcccaatctttgaacacaatcgaccacggaggaacaatacacgtagaaggggataactaaaactttgtcgtgcaagagtattggaggacacactaacagcagaactttgccttcttaactcttgtttatgattgcttgaagtattacacatgtaataaaagatgattattttttttttcctaaaaaaagttcctttctttgaagatccccctgataaaaaagatcaaataatggaaacgctaatcataatcaaatcgggaggagaataaacgcaagaagtgtgcgtttctagctgagtaatggtgacaagacatagagtgactgtactctacaatgcccctgaggatatcggtaatcatatgcgccaaaatgacactcatttgactgttcgtggaggttctggtgtggttttacaacaaaggtggctattagagaggactggaagcttggataaatcctttacgagaatcacttggaggcccagagcggacttggctagaagtttaagcgttatagaaaatgaactgagtgctggcttttcagtttactcaaattcttcggatgtgccggaaaggtttattactaacccagtctacaattcatttcacagtgagaagtttgacatagagcagtacttgcctcccgaagtagatttgaatctgtcatggaatccagaagattttacatatgatatatcagtggagcccacacaaatccaaattgttgaatatcgtctgttgaaacagggtgaagaatttacaattgcaagagtgaaagatgagaaactcgaagtaggtgtattctttgtggatgcaagtgatgaaagtgatgtcgatattggtggaatacgttgtaattggaggatggacgatggtaaaatggaaagatgtcagaaaacatccttattgtataaacagggccatatcgcatacaatcactcgacgactacgacatcactatatctgaatgaacctatcggtttgcatccaaaaatcatgattgatctcacagatttcgaagaacgccctaaatgcatgtatctaatgcacctgcaattgccgttagaattatttatcgataaattccaatcctctcccttactactttttggagaagacgacttagaattaccagaatactctcttcgagataaggcatggggttctgaaagtatctttgaattgaaagccggcacaatgaatgaagtgacattgcatactagatatattgagccttctaataataaaggggataaattagaagtttcatttgatccagaagttatattagcctgcgacacaggtgacaataaagtttcccgtaatccattttataaaaaaggtctaggatatgaatctctctttacagacgatactacattccgccatttgaactcgacaactcttctagtaccaattccaaggcctgacacaaaggattattccaagatcaaaaatggtacgttactatgcttactcatctccatcatatacattttctccaaggtatttggtaacaacaagaagaaaagatcagtaaaacgggaataa

SEQ ID NO: 68 - protein, 416 aa, Saccharomyces cerevisiae
MVTRHRVTVLYNAPEDIGNHMRQNDTHLTVRGGSGVVLQQRWLLERTGSLDKSFTRITWRPRADLARSLSVIENELSAGFSVYSNSSDVPERFITNPVYNSFHSEKFDIEQYLPPEVDLNLSWNPEDFTYDISVEPTQIQIVEYRLLKQGEEFTIARVKDEKLEVGVFFVDASDESDVDIGGIRCNWRMDDGKMERCQKTSLLYKQGHIAYNHSTTTTSLYLNEPIGLHPKIMIDLTDFEERPKCMYLMHLQLPLELFIDKFQSSPLLLFGEDDLELPEYSLRDKAWGSESIFELKAGTMNEVTLHTRYIEPSNNKGDKLEVSFDPEVILACDTGDNKVSRNPFYKKGLGYESLFTDDTTFRHLNSTTLLVPIPRPDTKDYSKIKNGTLLCLLISIIYIFSKVFGNNKKKRSVKRE

SEQ ID NO: 69 - DNA, 1244 bp, Saccharomyces cerevisiae
ttaagaaaatgaacgttactatttccttcctcgttttagttacataaaatttactaatggttggaaaattgcggaagctatcacgcgataactaggtacacacgcattatttttataatcccattattaataaatccgttatgacccttttagtaataacttattaagaacctccgggtaaaatactgtactgcggggaaagaaggcgcttccccttcttggaacttaatataaataataaatttgcctaagggcattaggccttactgccttggctagcgtacttatttcgattcatacaatttgcactattccggcagctagttgatactataacatcctacatttttacttgttttacgttcatttttatttgaagtttgtaaactttatcagaaagaaaacaagaagaggaaaaaggaaaagaggggtcaggttagtatcaataaaaaaaaagagagtaaacaaaacaatacagactcaattgaagcactataagaatggtaaagattgcgataattacttactctacctacgggcacatagacgttttagcccaagctgttaagaaaggtgtggaggcagctggtggtaaagctgatatatacagggtcgaggaaactttacctgatgaagtcctcaccaagatgaacgctcctcagaaacctgaagatattcctgttgccactgagaaaacgttgctcgaatatgacgcctttttgttcggtgttccaactaggtttggtaatttgccggctcaatggtccgccttttgggataaaaccggtggattatgggccaagggctctttgaacggcaaagctgcggggatattcgttagtacttccagttacggaggtggtcaagaaagtaccgttaaagcctgtttgtcttatttagctcatcacggaattatctttttaccactgggttataagaattcatttgctgagttagccagtatagaagaggtacacggtggctctccatggggtgctggtacccttgcaggacctgacggctcaagaactgcgtctccacttgaattgagaattgctgaaattcaaggtaaaacattctacgaaaccgccaaaaaacttttccctgcaaaagaagccaagccctccactgaaaagaagaccactacttctgatgcggctaagagacaaactaaacctgcagcagctacaactgcagaaaagaaggaggacaaaggattattatcctgctgtactgtcatgtaa

SEQ ID NO: 70 - protein, 247 aa, Saccharomyces cerevisiae
MVKIAIITYSTYGHIDVLAQAVKKGVEAAGGKADIYRVEETLPDEVLTKMNAPQKPEDIPVATEKTLLEYDAFLFGVPTRFGNLPAQWSAFWDKTGGLWAKGSLNGKAAGIFVSTSSYGGGQESTVKACLSYLAHHGIIFLPLGYKNSFAELASIEEVHGGSPWGAGTLAGPDGSRTASPLELRIAEIQGKTFYETAKKLFPAKEAKPSTEKKTTTSDAAKRQTKPAAATTAEKKEDKGLLSCCTVM

SEQ ID NO: 71 - DNA, 1883 bp, Saccharomyces cerevisiae
agagttgttgccacaacataagccgctttggagtgttgaacaaatccgtccttgggtcattcaatcaatggcttggcggtatctcaaaagagcgcaaactaatagcgcgcacattcgacgcatttatccggtggtcatcgactaggggcgaagaggtcacgacctattttttcttgcagaaaaaaagtgtgaccttttccgtagctagacgtctatcagggcgtcagcaatgggaggcacagcggaaaaacaataacaatggtaagcgcaattaccttttgagcgttacattcgtatgaaattggtgacgttaatctaaagatagtcatgctctcaaaagggcccattattctcgacgttgagcgtatataagactattaaaacttggttctttagatatggtgttcgttcctcattattaagtttcagggaacaatatcaacacatatcataacaggttctcaaaactttttgttttaataatactagtaacaagaaaaatgacagttccttatctaaattcaaacagaaatgttgcatcatatttacaatcaaattcaagccaagaaaagactctaaaagagagatttagcgaaatctaccccatccatgctcaagatgtaaggcaattcgttaaagagcatggcaaaactaaaattagcgatgttctattagaacaggtatatggtggtatgagaggtattccagggagcgtatgggaaggttccgttttggacccagaagacggtattcgtttcagaggtcgtacgatcgccgacattcaaaaggacctgcccaaggcaaaaggaagctcacaaccactaccagaagctctcttttggttattgctaactggcgaggttccaactcaagcgcaagttgaaaacttatcagctgatctaatgtcaagatcggaactacctagtcatgtcgttcaacttttggataatttaccaaaggacttacacccaatggctcaattctctattgctgtaactgccttggaaagcgagtcaaagtttgctaaggcttatgctcaaggaatttccaagcaagattattggagttatacttttgaagattcactagacttgctgggtaaattgccagttattgcagctaaaatttatcgtaatgtattcaaagatggcaaaatgggtgaagtggacccaaatgccgattatgctaaaaatctggtcaacttgattggttctaaggatgaagatttcgtggacttgatgagactttatttaaccattcattcggatcacgaaggtggtaatgtatctgcacatacatcccatcttgtgggctcagcactatcatcaccttatctgtcccttgcatcaggtttgaacgggttggctggcccacttcatgggcgtgctaatcaagaagtactagaatggttatttgcacttaaagaagaggtaaatgatgactactctaaagatacgatcgaaaaatatttatgggatactctaaactcaggaagagtcattcccggttatggtcatgctgtgctaaggaaaactgatcctcgttatatggctcagcgtaagtttgccatggaccattttccagattatgaattattcaagttagtttcatcaatatacgaggtagcacctggcgtattgactgaacatggtaaaactaaaaatccatggccaaatgtagatgctcactctggtgtcttattacaatattatggactaaaagaatcttctttctataccgttttatttggcgtttcaagggcatttggtattcttgctcaattgatcactgatagggccatcggtgcttccattgaaaggccaaagtcctattctactgagaaatacaaggaattggtcaaaaacattgaaagcaaactatag

SEQ ID NO: 72 - protein, 460 aa, Saccharomyces cerevisiae
MTVPYLNSNRNVASYLQSNSSQEKTLKERFSEIYPIHAQDVRQFVKEHGKTKISDVLLEQVYGGMRGIPGSVWEGSVLDPEDGIRFRGRTIADIQKDLPKAKGSSQPLPEALFWLLLTGEVPTQAQVENLSADLMSRSELPSHVVQLLDNLPKDLHPMAQFSIAVTALESESKFAKAYAQGISKQDYWSYTFEDSLDLLGKLPVIAAKIYRNVFKDGKMGEVDPNADYAKNLVNLIGSKDEDFVDLMRLYLTIHSDHEGGNVSAHTSHLVGSALSSPYLSLASGLNGLAGPLHGRANQEVLEWLFALKEEVNDDYSKDTIEKYLWDTLNSGRVIPGYGHAVLRKTDPRYMAQRKFAMDHFPDYELFKLVSSIYEVAPGVLTEHGKTKNPWPNVDAHSGVLLQYYGLKESSFYTVLFGVSRAFGILAQLITDRAIGASIERPKSYSTEKYKELVKNIESKL

SEQ ID NO: 73 - DNA, 1298 bp, Saccharomyces cerevisiae
gtacaaaaatgattacgaaaatatagatgatgtaagcaaggtacggttataaacagttaacatataagtttacttcacttttttgctgactcctttacttgtcttccctgcactttgattttacttcagaaaaaataagatatatgtttctgataaaacttttaggttagcggagaagatgttgccacgaatatcatgtaattgaaaggcaacgaaaggtctatcgtttgccattcataatgtgattcgacttgtctttttcattgtaacagacatgaaacgtttcctttacgtccctatgaatttttgttggctgaactgggcgctgcaggggctggacgatccaaatgcgcggattttgaacaattatgagaatccgaattaaaagaaagggaaaacaaatttaataacaggcagacgtgagagaagaaaaggaaacgctgtgatatagaaaactatacaaatcctattataagaagccagaagaaagctgatacaagatgagttgggaaggttttaagaaagctatcaacagagctggtcacagtgtgataattaagaatgtcgacaagaccattgataaagagtatgacatggaagaacgtcgttataaagttcttcaaagagcaggtgaggcattacaaaaggaagccaaaggtttcttggactcattgagagctgtgacagcatcacagactaccattgccgaggtcatctctaacctctatgacgattcaaaatatgttgctggtggtggttacaacgttggtaactattatttgcaatgtgttcaagattttgatagcgaaactgttaagcaattagacgggcccttaagagaaaccgtactagatccaataacaaagttttcgacgtatttcaaagaaattgaggaggccataaaaaagagagaccataagaaacaagacttcgatgctgcgaaggcaaaagttcgtagattagtggacaaacctgctaaagatgcctctaaactgccaagggctgaaaaagaattgagcttagctaaagatattttcgaaaatcttaataaccaattgaaaactgaactaccacagttagtttcattaagagtaccttactttgacccaagttttgaagctttaatcaagattcagctaaggttctgtactgatggttacactcgtttagcgcagattcaacaatatttggaccaacaatcaagagacgactatgccaatgggttattagacactaaaatcgaagaactattaggacaaatgacaagcctagatatttgtgcgctcgggataaaataa

SEQ ID NO: 74 - protein, 265 aa, Saccharomyces cerevisiae
MSWEGFKKAINRAGHSVIIKNVDKTIDKEYDMEERRYKVLQRAGEALQKEAKGFLDSLRAVTASQTTIAEVISNLYDDSKYVAGGGYNVGNYYLQCVQDFDSETVKQLDGPLRETVLDPITKFSTYFKEIEEAIKKRDHKKQDFDAAKAKVRRLVDKPAKDASKLPRAEKELSLAKDIFENLNNQLKTELPQLVSLRVPYFDPSFEALIKIQLRFCTDGYTRLAQIQQYLDQQSRDDYANGLLDTKIEELLGQMTSLDICALGIK

SEQ ID NO: 75 - DNA, 1352 bp, Saccharomyces cerevisiae
gagctccgtggaataggcgagcggctgagtggttctccaagctacggtttttacgtgtagccccatgtgagcaagccaaacaagggcccttaaaggcgtgactacaaaaaggggcgggttggaaggtcatctgcagcgagatacgaaaagattttttgccagatttgcggttgggcggctatttcggtattgttggggtaacaaacgttggggaagactgcattttcttacagctttttttcgttatcgcgggttgggcggctatggcgccttctcctctgtactccaacctgtcagagacaccaagctgtatataaagcaccttggttggatcgtatttccctgagatcttgctataggttcattttatatatcgtccaatagcaataacaatacaacagaaactactagcatctgtttataagaaaaaggcaaatagtcgacagctaacacagatataactaaacaaccacaaaacaactcatatacaaacaaataatatgtctgacaaggaacaaacgagcggaaacacagatttggagaatgcaccagcaggatactatagttcccatgataacgacgttaatggcgttgcagaagatgaacgtccatctcatgattcgttgggcaagatttacactggaggtgataacaatgaatatatctatattgggcgtcaaaagtttttgaagagcgacttataccaagcctttggtggtaccttgaatccagggttagctcctgctccagtgcacaaatttgctaatcctgcgcccttaggtctttcagccttcgcgttgacgacatttgtgctgtccatgttcaatgcgagagcgcaagggatcactgttcctaatgttgtcgtcggttgtgctatgttttatggtggtttggtgcaattgattgctggtatttgggagatagctttggaaaatacttttggtggtaccgcattatgttcttacggtgggttttggttgagtttcgctgcaatttacattccttggtttggtatcttggaagcttacgaagacaatgaatctgatttgaataatgctttaggattttatttgttggggtgggccatctttacgtttggtttaaccgtttgtaccatgaaatccactgttatgttctttttgttgttcttcttactagcattaactttcctactgttgtctattggtcactttgctaatagacttggtgtcacaagagctggtggtgtcctgggagttgttgttgctttcattgcttggtacaacgcatatgcaggtgttgctacaaagcagaattcatatgtactggctcgtccattcccattaccatctactgaaagggtaatcttttaa

SEQ ID NO: 76 - protein, 283 aa, Saccharomyces cerevisiae
MSDKEQTSGNTDLENAPAGYYSSHDNDVNGVAEDERPSHDSLGKIYTGGDNNEYIYIGRQKFLKSDLYQAFGGTLNPGLAPAPVHKFANPAPLGLSAFALTTFVLSMFNARAQGITVPNVVVGCAMFYGGLVQLIAGIWEIALENTFGGTALCSYGGFWLSFAAIYIPWFGILEAYEDNESDLNNALGFYLLGWAIFTFGLTVCTMKSTVMFFLLFFLLALTFLLLSIGHFANRLGVTRAGGVLGVVVAFIAWYNAYAGVATKQNSYVLARPFPLPSTERVIF

SEQ ID NO: 77 - DNA, 1148 bp, Saccharomyces cerevisiae
tgaaaaatgatgaaggcacattgttaattgaagaagaagaagaagaagaaacaaaattaaaaccgattgaccaatatatgtctctgaatgccaaggatggaaattattgcagaagattagactttttttgttgcaagtgggatgagcttggagcaggaagaatacactatactggatctaaagagtacaatagatggataagaatattggcagcgcaaaaaggcttcaagcttacacaacacggtttatttcgaaataatatccttctcgaaagctttaacgaacgcagaattttcgagttattaaacttaaaatacgctgaacccgaacatagaaatatcgaatgggaaaaaaaaactgcataaaggcattaaaagaggagcgaatttttttttaataaaaatcttaataatcattaaaagataaataatagtctatatatacgtatataaataaaaaatattcaaaaaataaaataaactattattttagcgtaaaggatggggaaagagaaaagaaaaaaattgatctatcgatttcaattcaattcaatttatttcttttcggataagaaagcaacacctggcaattccttaccttccaataattccaaagaagcaccaccaccagtagagacatgggagatcttgtcagtgacaccgtacttcttagcgacagtggcagtgtcaccaccaccaatgatgacggtgttaccagcagcagagctcttgacaacttcgtctaacaaagccttagtaccagcagcgaacttttcgaattcgaaaacacctggtggaccgttccagacaatggtcttagcctttgcaacagtagcagcaaacaactttctagattctggaccattgtccaacccttgccagccagctggaataccttccttgtcagtgacagtcttggtgttggcatcagcagagaaagcatcagcaatgatgaagtcgactggcaagacgacttcgacacccttggccttggccttttccatcaactttggaacgatttcagcaccagccttgtcgaagatggagtcaccgatttcagtgttttccaaaaccttcttgaaggtgaaagccataccaccaccaatgatgatagagtcgaccttgtccaacaagttgtcaatcaattga

SEQ ID NO: 78 - protein, 215 aa, Saccharomyces cerevisiae
MGKEKRKKLIYRFQFNSIYFFSDKKATPGNSLPSNNSKEAPPPVETWEILSVTPYFLATVAVSPPPMMTVLPAAELLTTSSNKALVPAANFSNSKTPGGPFQTMVLAFATVAANNFLDSGPLSNPCQPAGIPSLSVTVLVLASAEKASAMMKSTGKTTSTPLALAFSINFGTISAPALSKMESPISVFSKTFLKVKAIPPPMMIESTLSNKLSIN

SEQ ID NO: 79 - DNA, 1499 bp, Saccharomyces cerevisiae
atcgaaagcgtgctttgtaagaatatttggtatggctaaagtaagcaaagccatatcccgatcccgatcccgactcttattccgatcccttccgccacatcctgcatgtttattcgaataccaaattagctcatcttcgttatttcatcatccctttctgctatggcaaggacaagtttttttctagcatctcatcgaaaactttcctctccctaattggccaaagttttcatattcatcatcagttagaaagtataatatcaatcccttacctcattacaagttgtatcacactaaaaaaatcatatataagtctgtgagagtcttcaattatttagcgtaacacctattcactttctaatcttgtttcttgtttttacattctgcaatacaacacaacaacaaatattaactcaattattattatttataattacaaaaacaaaacaacaagtttgagactttaatatcttttgattactaaaaacaacaaatttcaaatgaacgatacgctatcaagctttttaaatcgtaacgaggctttagggcttaatccaccacatggcctggatatgcacattaccaagagaggttcggattggttatgggcagtgtttgcagtctttggctttatattgctatgctatgttgtgatgttcttcattgcggagaacaagggctccagattgactagatatgccttagctcctgcatttttgatcactttctttgaattttttgctttcttcacttatgcttctgatttaggttggactggtgttcaagctgaatttaaccacgtcaaggttagcaagtctatcacaggtgaagttcccggtattagacaaatcttttactcgaaatatattgcctggttcttgtcctggccatgccttttatttttaatcgagttagccgctagtactactggtgagaatgacgacatttccgccttggatatggtacattcgctgttaattcaaatcgtgggtaccttattctgggttgtttcgctattagttggttcattgatcaagtccacctacaagtggggttattacaccattggtgctgtcgctatgttggttacccaaggtgtgatatgccaacgtcaattcttcaatttgaaaactagagggttcaatgcacttatgctgtgtacctgcatggtaatcgtttggttgtactttatctgttggggtctaagtgatggtggtaaccgtattcaaccagacggtgaggctatcttttatggtgttttggatttatgtgtatttgccatttatccatgttacttgctaattgcagtcagccgtgatggcaaattgccaaggctatctttgacaggaggattctctcatcaccatgctacggacgatgtggaagatgcggctcctgaaacaaaagaagctgttccagagagcccaagagcatctggagagactgcaatccacgaacccgaacctgaagcagagcaagctgtcgaagatactgcttag

SEQ ID NO: 80 - protein, 332 aa, Saccharomyces cerevisiae
MNDTLSSFLNRNEALGLNPPHGLDMHITKRGSDWLWAVFAVFGFILLCYVVMFFIAENKGSRLTRYALAPAFLITFFEFFAFFTYASDLGWTGVQAEFNHVKVSKSITGEVPGIRQIFYSKYIAWFLSWPCLLFLIELAASTTGENDDISALDMVHSLLIQIVGTLFWVVSLLVGSLIKSTYKWGYYTIGAVAMLVTQGVICQRQFFNLKTRGFNALMLCTCMVIVWLYFICWGLSDGGNRIQPDGEAIFYGVLDLCVFAIYPCYLLIAVSRDGKLPRLSLTGGFSHHHATDDVEDAAPETKEAVPESPRASGETAIHEPEPEAEQAVEDTA

SEQ ID NO: 81 - DNA, 983 bp, Saccharomyces cerevisiae
ataaacataagatataatagtttttaaaatggtcaacgtatgcgatgcacaactaaaaggtaccaattcattaaatattataatatttacttcttactattacacgaaagacaagtgtgaaatgcctaggagattgatgattgacaagctctggccttgcaataaaaatacttatacacaacttcaaataatatagaaaagaaagaagactataagctaaaaatgtagacaacctcatttaaatattattcttaggacttggtaataatagctaatttgtatattattcacctcggtcaccgcctgtaatcacctttaacgaaaatagatgcccagccaatcaaagcgcattatggagtcgtctaggaaggggccgtcccatcattgtaaaagttcatgttaaattagatggaggataacaataaaggtatcgtacacacactgctaaaagagcctcaatcaatttgtgaaggtataactgtagccgtgaggataggaaaatgttacgttcaattattggaaagagtgcatcaagatcattgaatttcgtcgctaagcgttcatatgcagaagctgctgccgcatcatcaggtttgaagttacaatttgctctaccacacgaaactttatatagtggctccgaagttactcaagtgaacctgcctgctaagtcaggacgtattggtgtattggccaaccatgttcccaccgttgaacaattactaccaggtgtcgttgaagttatggaaggctctaactctaaaaaattctttatatcaggtggatttgcaacagttcaaccagactcgcagttatgtgtaactgcaattgaagcttttccattggaatccttttcacaagaaaatataaaaaatttgttggcagaagctaagaagaacgttagttcatctgatgccagggaagccgcagaagctgcaattcaagtagaagttttagaaaacctacaatccgtattgaaatag

SEQ ID NO: 82 - protein, 160 aa, Saccharomyces cerevisiae
MLRSIIGKSASRSLNFVAKRSYAEAAAASSGLKLQFALPHETLYSGSEVTQVNLPAKSGRIGVLANHVPTVEQLLPGVVEVMEGSNSKKFFISGGFATVQPDSQLCVTAIEAFPLESFSQENIKNLLAEAKKNVSSSDAREAAEAAIQVEVLENLQSVLK

SEQ ID NO: 83 - DNA, 1217 bp, Saccharomyces cerevisiae
aaagtatcaagttcgctaaatttacttcgaagacagaagccagtaaattttgttttcttcatggaaatagtttccaaaaagttcttagtaattaccatatgttcttgtatgtggcgctgcgaaagaaaggttagccgaccggcatcacccataattgtataatatagcaatgaagcaacttgttgaagttttctttaaagtactatagtattgaataatatcatgttcacttgataaaattgggtattttattgaccattatatcgcgttggacactaatgtctttcaagttggtgtcacgtcacgtgcttttcaatgtactggggcaaattgattagaggaagccacagtttggcaagggcagatatgataggaagcagtaacggcaaggaaggataagaacatcattgagggagtctgtggcagtttagcacatgctttggaccattaaagggttacgtagaggagaagagcatatttcaggataaacagacaaaataatgacgatacaagcgaagcccagttcgagcatatcgtatgattcgactacatacggcacagcaccgggcttggatataaaagagttccaaatcatcgaagattggaatggaagacctgccagcgcttggtcggtgcagaggattgggcttctacagtccaagatcgaaaggtacacgtacaatatttaccacaataataaatatgggaagcacaacttatctaagctgataccagggcatgctctcattcagttcgctaatgaaacattcgggtatgatggttggcgaatggatgttatagatgttgaggcccgggagtgccagcccttcaccgcagtaaataatggagaaaacaccaacactagtgaggtcaagtatacagttgtggcagaagcccaagtaaaggttaccttaaaggatggcaccaacacacagtgtggtgggctaggtagaattactttgtcctcgagaggtgaatgttataacaggtcgaaaaaagaggctgtaggcgatgcgttaaagaaggcgttattgagctttgaaaaaatcatactcgattatgagactaagattacaaataattactatgtcgatggcttgtatggctcaaaaaaaattaaaaatgaagctaacaccaattacaacttattgtcagcgactaatagcaagccgacttttatcaaattggaggatgctaaaggcacgcatatcaaataa

SEQ ID NO: 84 - protein, 238 aa, Saccharomyces cerevisiae
MTIQAKPSSSISYDSTTYGTAPGLDIKEFQIIEDWNGRPASAWSVQRIGLLQSKIERYTYNIYHNNKYGKHNLSKLIPGHALIQFANETFGYDGWRMDVIDVEARECQPFTAVNNGENTNTSEVKYTVVAEAQVKVTLKDGTNTQCGGLGRITLSSRGECYNRSKKEAVGDALKKALLSFEKIILDYETKITNNYYVDGLYGSKKIKNEANTNYNLLSATNSKPTFIKLEDAKGTHIK

SEQ ID NO: 85 - DNA, 1263 bp, Saccharomyces cerevisiae
actatattttgttttcccgaacctctccccttctgggccctttttccattattcacaatattttcatacctttacctccgtacaccaatctttatttttacccccatacctttgtattctgaaattgagaaatgatttgtggtgcttttttttttggacaatctgccttcgtggacagttttgaaacgctaggcgacagttttgcaacggaaggaagtgggagagcccagaaaggctttctctcgatggtggatcattcttgcgcaggcggaggatgggaaagctccgttcaggtttgcggcttttctttctggcattttcgttctcccaactgcgcaggcagacatagcttgactttactcatgctcgcattaggcgggttgaatctcatagcttgaaagatagtattgaattatattgaagattttataactagtgataatttcattcaagttttaaagaaagaattaataagcaaacagaactcaatcaaaggaaaaatggccggtttgaaagacgttgtcactcgtgaatacaccattaacttgcacaaaagagtatgtgaaagaataaaaatataatgcccaagggcttgtcatctgaatggttaattaagaagatatttctatagtcaaggaatacaatatcaagaatttgtaccacagaaacctatcaacaaagatcattgatcaagatatattttataatacggaatttgaagaccataatcaatattataacatccaagaggggaaagatacacttcggctggacttaaagagcgatgaagacagaaatagttatcttaaatagtggaatcctagattttaagtcgacaattatccatatcccaagtttgactaaatatgaatcagaacaaattgggtctccaatatacaaaaccattcatcaagattacactaatattaaaatgaacaatcgttactaacaaaaaatttaccattttatttttaatagttgcacggtgtctccttcaagaagagagctccaagagctgtcaaggaaattaagaagttcgccaagttacacatgggtactgatgatgtccgtctagctccagaattgaaccaagctatctggaagagaggtgtcaagggtgttgaatacagattaagattgagaatttccagaaagagaaacgaagaagaagacgccaagaacccattgttctcctacgttgaacctgtcttagttgcttctgccaagggtctacaaactgttgttgtcgaagaagatgcttaa

SEQ ID NO: 86 - protein, 113 aa, Saccharomyces cerevisiae
MAGLKDVVTREYTINLHKRLHGVSFKKRAPRAVKEIKKFAKLHMGTDDVRLAPELNQAIWKRGVKGVEYRLRLRISRKRNEEEDAKNPLFSYVEPVLVASAKGLQTVVVEEDA

SEQ ID NO: 87 - DNA, 1838 bp, Saccharomyces cerevisiae
actcttctctgatttcagcaatggccttttttttttcttcacgatcatactccttcgcttgtcttttggaattctttttattcttacttttgacgtttgtttgacctgtgagtccacgggccttcaaggcggcctttaaattcttaagttgtgaaccggccatgtatttgatcttcccttttatttgcttctcaactgtactatttacagtaataattagtgcaaccttcagatgcttctcgctaaatgctcatctctaaattatcattattattcctaataaatcctaaaatttttcactcgttctgtacggctcatcgccccaatattacccgtcttgtatgtgatctttttgacttttcggtggcaaaatgcaaaggggaatccaaggaaaaaccataacaggacactacatcagagataatcttgaattaagagagtagaggaatatactgctgggctcactaccatttttgttgctagagtaaacgtagagaaagatgtcaagagatgcaccaattaaggctgacaaggattatagccaaattttgaaggaagagtttcctaagatcgattcgctcgctcaaaatgattgtaactctgctttagaccaactgttagtgttggagaagaaaaccagacaagcttcagatctggcctcctcgaaagaagttttggccaagattgtagatctgctagcatcaaggaataagtgggacgacctaaatgagcaattgactctactctcaaaaaagcatggtcagttgaaattgtcaattcagtatatgatacaaaaggttatggaatatttgaaaagctcgaaatctttggatttaaacaccagaattagtgtcattgaaactatcagggtggttacagagaacaaaatatttgtagaagtggaaagagctagggtcaccaaagatttggtggaaattaagaaagaagagggtaagattgatgaagctgcagacatcttgtgtgagttacaggttgagacctatggctccatggaaatgtctgagaaaattcagtttatattagagcaaatggaattgagtatattaaaaggtgattattcccaagccacggtgctttcaagaaaaattctgaaaaaaacttttaaaaatccaaaatacgagtcattgaagctagaatattataatcttctggtaaaaattagtttgcacaagagagaatacctagaagttgcgcagtatctgcaagaaatttatcaaacagacgccattaaatcagatgaggctaagtggaaacctgttttatcgcacattgtatatttcttagtcctttcaccttacggcaatttacaaaatgatttaattcacaaaatccagaatgataacaacctgaaaaaattagaaagccaagaatctttagtaaaattgtttactacgaatgagttgatgagatggccaattgttcaaaaaacctatgagcccgtcttaaatgaggatgatttggcatttggtggagaagctaataagcatcactgggaagatttacaaaaaagggtcatcgagcacaatttaagagtcatttccgaatactattccagaattactttactaagattgaatgaattgctggacctaacggagagccagacggaaacatacatcagtgatttggtaaaccagggcatcatatacgctaaagttaatcgcccagccaaaatcgtgaattttgaaaaaccaaaaaactcaagccaattattgaacgaatggtcacataatgttgacgaactattagaacatatagaaacaataggccatttaattacaaaagaggaaatcatgcacggtttgcaagctaaatga

SEQ ID NO: 88 - protein, 445 aa, Saccharomyces cerevisiae
MSRDAPIKADKDYSQILKEEFPKIDSLAQNDCNSALDQLLVLEKKTRQASDLASSKEVLAKIVDLLASRNKWDDLNEQLTLLSKKHGQLKLSIQYMIQKVMEYLKSSKSLDLNTRISVIETIRVVTENKIFVEVERARVTKDLVEIKKEEGKIDEAADILCELQVETYGSMEMSEKIQFILEQMELSILKGDYSQATVLSRKILKKTFKNPKYESLKLEYYNLLVKISLHKREYLEVAQYLQEIYQTDAIKSDEAKWKPVLSHIVYFLVLSPYGNLQNDLIHKIQNDNNLKKLESQESLVKLFTTNELMRWPIVQKTYEPVLNEDDLAFGGEANKHHWEDLQKRVIEHNLRVISEYYSRITLLRLNELLDLTESQTETYISDLVNQGIIYAKVNRPAKIVNFEKPKNSSQLLNEWSHNVDELLEHIETIGHLITKEEIMHGLQAK

SEQ ID NO: 89 - DNA, 1495 bp, Saccharomyces cerevisiae
tgacggtcgtttcacaggaatggaagatgctttatgccggcgcattagaaatgatcagagaggagtgcggtacttttaaattgatagaggtttcttcaggtttggaggatgactcagacgttgaagaattgagggagcaattagaaaattgttagtatagtctatcttaaacactaaactacctcctataatcatgtagtgtactttaaacatttttttatcttcatagcaataatataagccttttaccacccataaaccataaagtagacccaaacatttttaaaaaaattttacgttataattttttctttgtcgttttttctgagcgcgcaaagtagcggtgaaattttgatacgaatgagatttccacttctgtacagatggaaatttatgttggccgacatatatcacagtcgtgattgaattaacaatttctttctcattaatatttattctaaacggttaaccactaaatcaatcaacaacaatcagtcaaaatgggtcgtatgcacagtgccgtatgtttattaacaccatagcgagatattaatgcaaaagttgcattgaatagttcgctaaatcagatgacactctaatgtggaattcaaaagtggatttctaatataatttgtctctgtcggatcacaattctattacaagttccggtgtgtacacaggtatagtttatactggagagtagtttctactcgctgtacattagctgggtgattccaatttcttttacaaatatgttgcattagtttaacaggttatactatctgccgtttctcagtataatttacgccggaaaattactgatggctagccgcctttatgaattagttttcacaaagctcataacataacacgttaacctatcggaggagaaccaagattgaagaatcacccggaatagttatactttaatggaattgtatggtctgaacgaggaaatatgtcatgatacacttttcttcaagccatatgaatcttcatgttactaacattcgataaattttttggaatatccaattccactaaatattactttaaacagggtaaaggtatttcttcttctgctattccatactctagaaatgctccagcttggttcaagttgtcctctgaatctgtcattgaacaaattgtcaagtacgcgagaaagggtttgactccatctcaaattggtgtcttgttgagagatgctcacggtgttacccaagctcgtgttatcactggtaacaagatcatgagaatcttgaagtccaatggtttggctccagaaatcccagaagatttgtactacttgattaagaaggctgtctctgttagaaagcacttggaaagaaacagaaaggacaaagacgctaagttcagattgattttgatcgaatctagaattcacagattggccagatactacagaactgttgctgtcttaccaccaaactggaagtacgaatccgccactgcctccgctttggtcaactag

SEQ ID NO: 90 - protein, 151 aa, Saccharomyces cerevisiae
MGRMHSAGKGISSSAIPYSRNAPAWFKLSSESVIEQIVKYARKGLTPSQIGVLLRDAHGVTQARVITGNKIMRILKSNGLAPEIPEDLYYLIKKAVSVRKHLERNRKDKDAKFRLILIESRIHRLARYYRTVAVLPPNWKYESATASALVN

SEQ ID NO: 91 - DNA, 1010 bp, Saccharomyces cerevisiae
gttagcttgccttgcatttccccatgcgtctcgaataggaattattcaagatggattattggcatttacgagtaaccaaggataaccccgctgtgcgtgaaaccaccctcttttcacgtttcttcaaggccagtgcaaacgcgaataaacatatctacgctatatatagatatgacgtttctcaagccaacagaagtagataaagcagccaggagggtagagagtgttcaaattatagcaagccttcttctacctgtttttttttgatgattgttttgccgggtaacaatcgactttcgggcaaattttttttccttttttctcctaacagtatatacggagtggagaacagacttcccataaaagcatattacgtggggtcgtagtaagattgccgtttatgataccctctattcagggctcagagcgcatcacgatcgggagtgtaaattcaatgtgcatataagcaaaacacacagatttccttttttcccagaaaaatgagcagtgaaattgcctactcgaatacgaacaccaacactgaaaacgagaaccgcaatactggcgctggcgtagatgtaaatacaaatgcaaatgcaaatgcaaatgcaactgcaaatgcaactgcaaatgcaactgcaaatgcaactgcagagctgaacctccccacggtcgatgagcaaagacagtataaggtacaactgctattgcatatcaacagcatattacttgctagagttattcagatgaataatagtttacaaaacaatctacagaacaatataaataatagcaataacaataacatcatcaggatacagcaacttatatctcagttccttaaaagggttcatgccaatcttcaatgcatatctcagataaaccaaggagtgccctcagcgaaaccactgatcctcacgcctcctcagctagccaaccagcagcaacctccacaggatattctttctaaactctatcttctcttggcaagagtgttcgagatatggtag

SEQ ID NO: 92 - protein, 169 aa, Saccharomyces cerevisiae
MSSEIAYSNTNTNTENENRNTGAGVDVNTNANANANATANATANATANATAELNLPTVDEQRQYKVQLLLHINSILLARVIQMNNSLQNNLQNNINNSNNNNIIRIQQLISQFLKRVHANLQCISQINQGVPSAKPLILTPPQLANQQQPPQDILSKLYLLLARVFEIW

SEQ ID NO: 93 - DNA, 1322 bp, Saccharomyces cerevisiae
ttgttacgaccaatccgtaattcaagcgtgggtattcatatgaccagagataataatacagcgaatactattgaaatcgtcccttttttgtttaggaagaacggacaaatcggtcgtctgctcgaaatgattagtagtgtgtcacccggatcagcaaaatgacacacacgaaatacgaggaaaaagtcggtcgaaaggggcaaatgttattataagtccctccagtagtcttttttttttcaaatattcatcatcaaaggttacgaaatcttttgagctatcttaaacattcgttctttttatcaaatttcaattactaacttattttttcaaaaaaaattgcctctcccggtttttaatcattatttttttcgattgattaagggggaaaagcaaagaacgagaaaacttggacagaaggttaatactctgacaatttcaaaacgaagtaaaaagaaaaattatcaaatcaacaaaaagtacccgttacaacaaaaaaaatgtcccaaactcgtgaagattctgtttacctagctaaattagctgaacaagccgaacgttatgaagaaatggtcgaaaacatgaaggccgttgcttcatcaggtcaagagttatctgtcgaagaacggaatctattgtcggttgcttacaagaacgtcatcggtgctcgccgtgcttcatggagaatagtttcttcgatcgaacaaaaagaagaatcaaaggagaaatctgaacatcaagttgaattaatccgttcttaccgttctaaaattgaaactgaattgaccaaaatctctgacgacattttatctgtgttagattctcatttaatcccttctgctactactggtgagtctaaagtattttactataagatgaagggtgactaccaccgttatttagctgaattttccagcggagatgcaagagaaaaggcaaccaactcctctttggaggcttataaaaccgcttccgaaatcgccacaactgaattgcctccaactcacccaattcgtttaggtctagctttgaatttctccgtcttctattacgaaattcaaaactctcctgataaggcttgccacttggccaaacaagcctttgatgatgctattgctgagttagatactttatctgaagaatcatacaaggatagcactttgatcatgcaattattaagggacaacttgaccttatggacctctgatatttctgaatctggtcaagaagatcaacaacaacaacaacaacagcaacagcaacagcaacaacagcaacaacaagctccagctgaacaaactcaaggtgaaccaaccaaataa

SEQ ID NO: 94 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 95 - DNA, 836 bp, Saccharomyces cerevisiae
gtgcagagggtgaatcaacggccccttcacagaaaccgcgcaggaatttttctggtgtttgttatttttttttccttgtacttatctcacttttctttttctaactattttttttgcaatttttttgtgtacactttccacaacatataggatggtttagtcatctctcgaagtatataaaccgttgctggatcgtggttgttcttcatcgacttctctctgctagactctcttttttaaaattttttcatagaataaaaaaccaaggataacaaacatcttctttcgttcgcttcaaaataactacaaattaaaaatgcaattctctaccgtcgcttctatcgctgctattgccgctgttgcctccgccgcttctaacattaccactgctactgtcacagaagaatctaccactttggtcactatcacttcttgtgaggaccacgtttgttctgaaacagtttccccagctttggtttccactgctaccgtcaccgtaaatgacgttatcacttaatacaccacctggtgtccattgccaaccactgaagcaccaaagaataccacttctccagctccaactgaaaagccaaccgaaaagccaactgaaaagccaacccaacaaggttctagcactcaaactgttacctcctacactggtgccgctgttaaggctttgccagctgccggtgctttgttggctggtgctgccgctttattgttgtaatttactcaaccttttctttaatatatttttagaaaaatggttaagtacttttccgtcaatacagcttccacaaaatcgttttatttcaattaataagatattctggtaa

SEQ ID NO: 96 - protein, 111 aa, Saccharomyces cerevisiae
MTLSLNTPPGVHCQPLKHQRIPLLQLQLKSQPKSQLKSQPNKVLALKLLPPTLVPLLRLCQLPVLCWLVLPLYCCNLLNLFFNIFLEKWLSTFPSIQLPQNRFISINKIFW

SEQ ID NO: 97 - DNA, 701 bp, Saccharomyces cerevisiae
ggagttttcctatttcgaattgatggctgggtttgagctgcaggacacgctgcagtggggaagcccttttaaatccgcgagtccggtccgtgctcacttttagacgcgtgttccatcggcgttcggatggtttccagtgagaaaaggggctacgcgtatggtcggtagtccctttcagggaccagtgcagagggtgaatcaacggccccttcacagaaaccgcgcaggaatttttctggtgtttgttatttttttttccttgtacttatctcacttttctttttctaactattttttttgcaatttttttgtgtacactttccacaacatataggatggtttagtcatctctcgaagtatataaaccgttgctggatcgtggttgttcttcatcgacttctctctgctagactctcttttttaaaattttttcatagaataaaaaaccaaggataacaaacatcttctttcgttcgcttcaaaataactacaaattaaaaatgcaattctctaccgtcgcttctatcgctgctattgccgctgttgcctccgccgcttctaacattaccactgctactgtcacagaagaatctaccactttggtcactatcacttcttgtgaggaccacgtttgttctgaaacagtttccccagctttggtttccactgctaccgtcaccgtaaatgacgttatcacttaa

SEQ ID NO: 98 - protein, 66 aa, Saccharomyces cerevisiae
MQFSTVASIAAIAAVASAASNITTATVTEESTTLVTITSCEDHVCSETVSPALVSTATVTVNDVIT

SEQ ID NO: 99 - DNA, 2120 bp, Saccharomyces cerevisiae
aagtgattatctgaataatgaaagatggtaggaaataaggtattgaaacaggttcaaaactttaaaagaaaactgccaaataaactttctcgatgcgtagctgaaatttcaacttcaaaaaaaaaaaaacgcgtgtaactttctacgtgcaaaacgatgtgtatgaatcccgtcttaattagtaaatagggtctagtaagcgtagcgaggatgaattaaatgcattgttgaatatgaagagcaccttatggtatataaatgtacaatcttgattcatgacagctttgcaagtaaacgtatcaaatgaatatcacgattttggctgtattacccgggcagtatacgcggcgaattttgttaaaaaatgtgttagacttaagtcggagcaaatgaataatgggcatatatagcgcataggttcgctagtgtaagacaggagactgtccaatagcattcgaatcataaccgaatctttgccagtgtgtgtataaaatacgacaatgtcttccaatccagaaaattctggtgttaatgcgaataataatacgggcactggtaacgctgatgcgatcacaggagctcagcaaaatatggtactgcaaccgagacagttgcaagaaatggccgctaagttcaggacattactgactgaagcaagaaatgtaggtgaaactactcctaggggcaaggaattgatgttccaagccgcaaagatcaaacaggtatatgatgcccttacactgaataggagaagacaacaggctgcgcaagcctacaataatacttcaaattcaaattcaagcaatccagcttctattcctactgaaaatgtccctaattcatcacagcaacaacaacaacaacaacaacagacaagaaacaacagtaacaaatttagcaatatgataaaacaggttctcaccccggaagagaaccaagaatatgaaaagctatggcagaatttccaagtccgtcatacgagtataaaggagaaagagacctacttgaaacaaaatattgataggttagaacaagaaataaataaacagacggacgaagggcccaagcagcagctacaagaaaagaaaattgaactgcttaacgattggaaggtgctaaaaattgagtataccaagctgttcaataattatcaaaacagtaaaaaaacattctatgtagagtgtgcaagacacaatccggctttacataaattcttgcaagaaagcactcaacagcaacgagtgcagcaacaaagggtacaacaacaacaacaacaacagcagcagcagcagcaacagcagcaacagcaacagcaacagcaacagcaacgccagggtcaaaaccaaagaaagatttctagttctaattctactgaaataccctctgtaaccggccctgatgcactgaaatcgcagcagcagcagcagaatacaataactgccaccaataatcccaggggcaatgttaacacttcacagactgaacaatcgaaagctaaggtaaccaatgtaaatgcaacggcatctatgttgaataatataagttcgagcaaatcggcaatattcaaacaaacagagcctgccatacccatatcggaaaatatatctaccaaaacaccagcaccggtagcttatagatccaacagacctacaataactggaggttctgctatgaatgccagtgctttgaatacaccagcaacaactaaattaccaccctatgaaatggatactcagagagttatgtcaaagcgtaaattaagagagttagtgaagactgtcggaattgatgagggtgacggtgaaactgtcattgacggtgatgttgaggaattactattggatcttgccgacgattttgttactaatgttacagctttttcttgtagattggcaaaacacagaaaatcggacaatttggaggcaagagacattcagttacatttggagagaaattggaatattaggattcctggttattccgcagacgaaataagaagtacaagaaaatggaatccctctcaaaattataaccagaaattgcagagtatcacatcagataaggtagcagctgcaaaaaacaatggaaacaatgttgcaagcttgaatacaaaaaaataa

SEQ ID NO: 100 - protein, 539 aa, Saccharomyces cerevisiae
MSSNPENSGVNANNNTGTGNADAITGAQQNMVLQPRQLQEMAAKFRTLLTEARNVGETTPRGKELMFQAAKIKQVYDALTLNRRRQQAAQAYNNTSNSNSSNPASIPTENVPNSSQQQQQQQQQTRNNSNKFSNMIKQVLTPEENQEYEKLWQNFQVRHTSIKEKETYLKQNIDRLEQEINKQTDEGPKQQLQEKKIELLNDWKVLKIEYTKLFNNYQNSKKTFYVECARHNPALHKFLQESTQQQRVQQQRVQQQQQQQQQQQQQQQQQQQQQQQRQGQNQRKISSSNSTEIPSVTGPDALKSQQQQQNTITATNNPRGNVNTSQTEQSKAKVTNVNATASMLNNISSSKSAIFKQTEPAIPISENISTKTPAPVAYRSNRPTITGGSAMNASALNTPATTKLPPYEMDTQRVMSKRKLRELVKTVGIDEGDGETVIDGDVEELLLDLADDFVTNVTAFSCRLAKHRKSDNLEARDIQLHLERNWNIRIPGYSADEIRSTRKWNPSQNYNQKLQSITSDKVAAAKNNGNNVASLNTKK

SEQ ID NO: 101 - DNA, 851 bp, Saccharomyces cerevisiae
tagacgggcttccacgcgcttccactcatttctgtctctggtaatggccgtggcccttctcactttggttgggcttacgctgacaagtgtctgttcgattccctgtataaatataaacgtattctcttgagccttctatccttttgccactgtcgtcatcatttgttcctcctttttcgctagataggttatattaagatttgtcttgaatttaatatctcaactcaatccaaactcaaccgctaatactaccatgtcccaagtctattttgatgtcgaagctgatggccaaccaattggccgtgtcgttttcaagttgtacaacgacatagtcccaaagactgcagaaaacttcagagctctatgtaccggtgaaaagggattcggctacgctggctctccattccacagagttattccagacttcatgttgcaaggtggtgacttcactgctggtaacggtaccggcggtaagtctatctacggtggcaaattcccagatgaaaacttcaagaagcaccacgacagaccaggtttgttgtccatggccaacgccggtccaaacaccaacggttctcaattcttcatcaccaccgttccatgcccatggttggacggtaagcatgttgtctttggtgaagttgttgacggttacgacatcgttaagaaggttgagtccttgggttctccttccggtgccaccaaggctagaattgttgttgccaagtccggtgaattataaccgctctgcctggaacaatacagcaaaaattgaaacgaactattctctcttaaattatatgtatatgtataaggtatgtgtatgtatgacaatcaattcttataactaa

SEQ ID NO: 102 - protein, 116 aa, Saccharomyces cerevisiae
MKTSRSTTTDQVCCPWPTPVQTPTVLNSSSPPFHAHGWTVSMLSLVKLLTVTTSLRRLSPWVLLPVPPRLELLLPSPVNYNRSAWNNTAKIETNYSLLNYMYMYKVCVCMTINSYN

SEQ ID NO: 103 - DNA, 1628 bp, Saccharomyces cerevisiae
ctggggttgggtaacaagtgagcaagggaaaaagtgaacattttaagaagaacaataaaatagcaagagatggaatggtaatgcttggctctcgagaagagtagcataaaacgagacttgtttaaaacaggatatgacatacttcaattcagctttccctatcagccgctcgagcagttatataggtgtgttgccggagtaatttggcggaggccaacagtggctaggcggcaacgcctggaacacgcgcttaaaagttctggaaggttcgcgaattgagaactgctcaggggcgaatacaggggcggccttggcggcaggggggaggcctctgtgaagttagttatataagacttgctgtcatcgtttttttgatcccggcaggaactatcttttattctcatacatacggtcaagaagtataattatacataacatagggacacgttcaggcaattgtccatatcccacacaaattaagatcataccaagccgaagcaatgagtttttatcaaccatccctatctctttatgacgttttgaacgcattatccaaccaaactggccagagagggcagcaaggatatcctcgccaaccacaaaggccacagagataccatccccattatggacaagtgcacgttggcgggcatcatcctcgtcatcatccattgtatagcagatacaatggtgttcctaatacctattactaccagttccctggacaagcctattactatagtcctgaatacggttatgatgacgaggatggtgaagaagaggaccaagacgaagatatggtgggtgacagcggcactacaagacaggaagatggtggcgaggacagcaactcgagaagatatccatcatattaccattgtaatactgccaggaataataggaccaaccaacaggcaaacagtttaaacgacttattaaccgcgttaataggtgttccaccatatgaaggcactgaaccagaaattgaagcaaataccgaacaggagggcgaaaagggagaagaaaaggataagaaggataagtctgaagcacccaaagaggaagctggcgaaaccaacaaagaaaaacctttgaatcagctggaggaatcgtcgagaccaccattagccaaaaaatcttcatcgttcgctcacctacaagcgccttccccaatacctgacccgttacaagtatccaagcctgaaacgagaatggacttaccattttcaccagaagtgaatgtctatgataccgaggacacttacgtagttgttcttgcgttaccaggtgctaactctagggctttccacattgattaccatccatcttctcatgagatgctcatcaagggtaagatcgaagacagagtgggcattgatgaaaaattcttgaagatcacggaactaaaatatggtgcgtttgagagaaccgttaaattccccgtgctgccacgcattaaggacgaagaaattaaagctacttacaacaacggtctactacaaattaaggtgcctaaaattgtcaatgacactgaaaagccgaagccaaaaaagaggatcgccattgaggaaatacccgacgaagaattggagtttgaagaaaatcccaaccctacggtagaaaattga

SEQ ID NO: 104 - protein, 375 aa, Saccharomyces cerevisiae
MSFYQPSLSLYDVLNALSNQTGQRGQQGYPRQPQRPQRYHPHYGQVHVGGHHPRHHPLYSRYNGVPNTYYYQFPGQAYYYSPEYGYDDEDGEEEDQDEDMVGDSGTTRQEDGGEDSNSRRYPSYYHCNTARNNRTNQQANSLNDLLTALIGVPPYEGTEPEIEANTEQEGEKGEEKDKKDKSEAPKEEAGETNKEKPLNQLEESSRPPLAKKSSSFAHLQAPSPIPDPLQVSKPETRMDLPFSPEVNVYDTEDTYVVVLALPGANSRAFHIDYHPSSHEMLIKGKIEDRVGIDEKFLKITELKYGAFERTVKFPVLPRIKDEEIKATYNNGLLQIKVPKIVNDTEKPKPKKRIAIEEIPDEELEFEENPNPTVEN

SEQ ID NO: 105 - DNA, 1046 bp, Saccharomyces cerevisiae
acgattaggcgtcaagtccttagaccccaatgacaacaacacagccaaccgtatcatcgaggaattgttgaagtgaatagataaaaaaaaaacgcaccaagtaagtaagtaaataaagaataaataaactatatgagtaaaacaccaagcgaggatgtttcattgtgcatccgtgttcttgatgatcacataactgtaaaagaataatacggcacgttaaatgttattttagaatatataaacaccttatgtgccataagcattgagccaatcgctgctgttttttttattccggggcaccttcggaagaacacaggcgcaatttagttatataaggagaagccctcgagcgatcaggggaccgactgcggatcgctttaaggcaaagatagaaggataaatatctgctttggaagatagtcgtatctaatttcccattctgttgttttcttgatctttcctacgctttcgactttcttcctacgcgctttataatagctatgatgttgccaagatccatgaaatttatgactggaaggagaattttccatactgccacagtaagggccttccagtctaccgctaagaagagcttaactatcccatttttgcccgtattaccccagaaaccaggtggtgttaggggcactcccaatgatgcctacgtccccccccctgagaataaattagagggctcataccactggtatatggaaaaaatctttgccttgtccgtcgttccattggctacgacggctatgctgacaaccggtccgttatccactgcagctgattctttcttttctgtcatgcttttgggatattgttacatggaatttaactcttgtatcaccgattatatttctgaaagagtttatggtgtttggcacaagtacgccatgtatatgttgggccttggttctgcggtctccctttttggaatctataaactagaaaccgagaatgatggtgttgttggtttagtaaaaagtctatgggattcttccgagaaagacaacagtcaaaagattgaagccaagaagtag

SEQ ID NO: 106 - protein, 181 aa, Saccharomyces cerevisiae
MMLPRSMKFMTGRRIFHTATVRAFQSTAKKSLTIPFLPVLPQKPGGVRGTPNDAYVPPPENKLEGSYHWYMEKIFALSVVPLATTAMLTTGPLSTAADSFFSVMLLGYCYMEFNSCITDYISERVYGVWHKYAMYMLGLGSAVSLFGIYKLETENDGVVGLVKSLWDSSEKDNSQKIEAKK

SEQ ID NO: 107 - DNA, 1556 bp, Saccharomyces cerevisiae
gaattccaaccggaaattgcaaacagcagcaatttctcgtaccgatgaaggggaacatggccgttgtaccgaggttccattggccgagtattagccagggccctaatacgtaactcggtacgctcttcagcttctttcgcataatcaacgttcttgttatgtaactcaccacgttccatggcatccgccaaccttgcttccttaccaaatattaatgagcctaaggtgtacattgccgccgcaggtaatattagcccacgacgttggcatttcactggcaaagtagctgttgatctcagtaaagataacctcaacatactcttttacttgtccttttttgtagctaattgctttcctccccttcttttccacaaaccgcaactatttttctctcaaaagttatatgaagtatatatactgaatggagcaattcggggttgagtgaattacaaaattatagtatctgatcaagcacacagtggaagtgctcgaaaagcaatatgagtgttgatttgtttccaaatgatagatttggtgcagaagataaatacgacaactttaaggatgccgtaaaagaatgctcctggctcatcgaagaaatcgtcaaaccgcaattacccaacattattgacaacttttctaaatgcctagagatgctagagagtgaccaaatattcaaaatgcctgtatctaatggtattcccaacgaaagtaacaaacaaaacgactctccgacggtaaagggtgttatcacaagacaaggccaatacattgttgactttcacattgttgtcagattcccacaatttcaaaggggtaaacaagttatgttccgaatgaatacgggactgaatttcttacttattcaattcagtaagataatgacgcacttgaaaaatattttggaaatactgaatcaacttcaagtagctacagatgtcagcgaattcgtatccaaatttggcgtggccatggaacttttgaaccattctctaatacttttacaaaatcctcctagagacctggtattcccagaagataacaactttgctatgaaggaaatgttccaggattgttactcagtctgcgaatccacagctcacatcctaggactggaacttacgctttgtaggaatgagctttgcatagaactacgaaatctaattaaggtgactaaaaaaccttggtgcgagattgatagtaaaactggcaggtcattttgcgaccaaataagaaatcaagtgacaaatgaaagaaacaaaactttatctaagatcctctcagaaaacggtgtacaagtccaggattccacattacttaaccacataatttcttcttttcaaagtgaagctataacacttccagaagctcaggaattattaagaaggggcgttactttcgataatagggtagtcatggaatgtgaaaagttaatagtatctacaagtgatccaactttgatcagtataagcgccaaattgaacagtctcaaagcttcgatggcgaaccatcaagcaaatttggtagctagcaaacagttaagtacatataagtaa

SEQ ID NO: 108 - protein, 351 aa, Saccharomyces cerevisiae
MSVDLFPNDRFGAEDKYDNFKDAVKECSWLIEEIVKPQLPNIIDNFSKCLEMLESDQIFKMPVSNGIPNESNKQNDSPTVKGVITRQGQYIVDFHIVVRFPQFQRGKQVMFRMNTGLNFLLIQFSKIMTHLKNILEILNQLQVATDVSEFVSKFGVAMELLNHSLILLQNPPRDLVFPEDNNFAMKEMFQDCYSVCESTAHILGLELTLCRNELCIELRNLIKVTKKPWCEIDSKTGRSFCDQIRNQVTNERNKTLSKILSENGVQVQDSTLLNHIISSFQSEAITLPEAQELLRRGVTFDNRVVMECEKLIVSTSDPTLISISAKLNSLKASMANHQANLVASKQLSTYK

SEQ ID NO: 109 - DNA, 4472 bp, Saccharomyces cerevisiae
caaagaacaacgccttaaaaataggaaaacgttttcgctacaggtgttgttattattgttgttgtgctgttgtttattgtgctatacttgtggtatttattctggacttccgatcggaaattttcttcccttgaagaccttttgaagacaacagttatatatcattgatctgaatttctcaggctattttcaaaattccatacctccttattccaacatttgctcgactactatagaaaagccttattcttttatctttgaaagaaagaaaaggtgtcatagcaaaagtttattgttactctgttttgatatactccctcttattcgttggaagtataagattgatttgcataaattaaccaatcattttgctactttcccggttctccctttattataaacacttcagaaaaatattctgctactattccttactttactataagaattttgttttccaaaaaaaaaaaatataaaaaaaataatcatactctattactatggctaacgtagaaaaaccaaacgattgttcaggctttcccgttgttgacttgaattcgtgcttttctaacggcttcaataatgagaaacaagaaatagaaatggaaacggatgattcaccgattttattaatgtcatcatcagcttccagagaaaactcaaacactttctctgtgatacagaggacgccagatggaaagatcattaccacaaataataatatgaactccaagattaacaagcaactggacaagttgcccgaaaatttaaggcttaatggtagaacccccagtgggaaactaaggtcatttgtttgcgaggtttgtacgagagcgttcgcaagacaagagcacttgaaaagacattacagatcgcatacaaatgaaaaaccttatccctgtggcctctgcaacagatgctttactaggagggacttactgatcaggcatgctcaaaaaatccatagtggtaatttaggggaaacgatttcccataccaagaaagtgtcgagaactataactaaagctcggaaaaattctgcatcctcagtcaagtttcaaactccaacctatggtactccagataatggtaattttttgaatcgcactactgccaatacaagaagaaaagcaagccctgaagctaatgttaaacgtaagtacttgaaaaaactgacgcgcagggcttcatttagcgcacaatcagcatccagctatgctttgcccgaccaatcttcgctagaacaacatccaaaggatcgtgttaaattttctacgcctgaattagttccacttgacttgaagaatcctgaacttgactcttcgtttgacctgaatatgaatctagatttaaacctaaatctagattccaatttcaatatagcattaaaccgttctgattcttctggatcaacaatgaatttggattataaattgcccgaatcagcaaataactacacatattcttccggctcaccaacccgcgcatatgtcggcgctaacacgaattctaagaacgcttcatttaatgacgcagacttattgtcgtcgtcgtactggataaaagcctataatgatcatttgttttcagtatctgaaagtgatgaaacttctccaatgaactctgaattaaacgacactaaattaatcgtcccagattttaaatcgactatacatcatttgaaggattcaaggtcctcctcttggactgttgctatagataataatagcaataacaataaggtatcagacaaccaacctgatttcgtcgattttcaagaactgctggataatgatactttaggtaatgatttgttagagaccactgccgttttaaaagaatttgaacttttacatgatgatagcgtaagtgctaccgccacgtcaaatgagattgacctttcccatttgaacctatcaaactctccaatttctcctcataagttaatttataagaataaagaggggaccaatgacgatatgttgatttctttcggactcgatcatccttccaatcgcgaagatgatctggataagctatgtaatatgaccagagatgttcaagccatattcagtcaatatttgaaaggagaagagtctaaacgatccctggaagactttttatcaacgtcaaacaggaaagaaaagccagatagcggcaactatactttttatgggttagattgtttaacgttatcgaaaatatcaagagctctgccggcctccactgtgaacaacaatcagccatcgcattccatagaatcaaagctatttaatgaaccaatgagaaatatgtgcattaaagtgcttagatactatgaaaagttcagtcatgatagtagtgagagtgtcatggactctaatccaaacttgctgtccaaagaattgttaatgccagctgtgagtgaattgaacgaatatttagatcttttcaagaataatttccttccccatttccctattattcacccaagcttgcttgatttggatttggatagcttgcaacgatatactaatgaggatgggtatgatgacgctgaaaacgcgcagttgtttgatcgattaagtcaagggacagataaagaatatgattacgagcactatcaaatcttgtccatttcgaaaatcgtttgtttacccttatttatggccacatttggttctttgcataagttcggttacaaatctcaaacaatagaattgtatgagatgagtagaagaattctacattcttttttggagactaaaagaaggtgtcgcagtacaacagtaaatgacagttatcagaacatttggttgatgcaatccctaatattgagcttcatgttcgctctagttgctgattatttggagaaaattgactcctctttgatgaaaaggcaattgtccgcattatgttcaacgatcagatcaaactgtttaccgacaatttctgcaaattctgagaagagtatcaataataacaatgaacctttaacatttggttctcctcttcaatacatcatttttgagtcaaaaattagatgcaccttaatggcttatgatttttgtcagttcttgaaatgtttcttccatattaaattcgatttgtctataaaggaaaaagatgttgaaaccatttatattcccgacaatgagtcaaaatgggccagtgaatcgataatatgtaatgggcatgttgtgcaaaagcaaaatttttatgattttagaaacttttattacagtttcacgtatggacacttacactcaataccagaatttttagggtcatctatgatttattatgaatacgatttaagaaaaggaaccaaatcacatgtgtttttggatcgaatcgatacgaaaaggctagagaggagtcttgacacttcttcctatggcaatgataatatggcagcaaccaataaaaatattgcgatcttaattgatgacaccataattttgaaaaataatttaatgtcaatgagattcatcaaacagattgatcgctcgtttactgagaaggttagaaaaggacaaatagcaaagatatatgattcctttttgaactctgtgaggttgaattttttgaagaattattcagttgaagtattgtgtgaatttttagtagcgttgaacttttcaatccgtaatatttcgtctttatacgtagaagaagaaagtgattgctcccaaagaatgaattctccagagctgccaaggatccacctgaataatcaagcgctttctgtcttcaatttacaaggctattactattgcttcatcctaattatcaaatttttattggattttgaagcaactccaaattttaagttactgagaatttttattgagttgagaagccttgcgaattctattttacttcccacactttcaagattgtatccgcaagagttttctggatttcctgatgttgtatttacgcaacaatttataaataaagataatggtatgcttgtccctggtttatccgcaaatgaacaccataatggtgcaagtgcagctgttaagactaagttagccaaaaagatcaatgttgaagggcttgcaatgtttattaatgaaatcctagttaactcttttaacgatacctcttttttgaatatggaggatcctattcgaaatgaattttcctttgataatggggacagggcagtgacagacttgcctcgttcagcacatttcctatcggataccggcctagaaggtattaacttcagcggcttaaatgattcgcatcaaactgtttctactttgaatcttttacgttacggggaaaatcattcatcaaaacataaaaatggtggaaaggggcaaggatttgccgaaaagtaccaattatctctgaaatatgttactattgccaagttatttttcaccaatgttaaagaaaactacattcattgtcacatgttagataagatggcaagtgatttccacactttggaaaatcatctaaagggaaacagttga

SEQ ID NO: 110 - protein, 1323 aa, Saccharomyces cerevisiae [sequence omitted]

SEQ ID NO: 111 - DNA, 896 bp, Saccharomyces cerevisiae
tttcttcaacaacgacgagttaactattgtgctctttttttgagccaccaaatacactccattccaatagcttcgcacagtgaggcgaaaattttggaacagcgctaatgaattatttgtgagctcggcgagttcaaatttgaagaaaacgcggttgggtcgttaactatggttagacgctcaatgtcgcccgaaagggaaggctgttctcactttttcgcgcgttgcaccctttcttccgcgaaaaaatgagaacgatggatttaaaatcaagagaattggccttagtagtggcaaatactaccttggttggttatcttgtaacgattggtaagaaaggggcatctctgttttcttgatgtatataaacaacatgatttgatcatctcagatggtcagatttattaaagacgtttctctttccgcattttcgattattgttatattaaatttatcctatatagacaagtcaaaccacaaataaaccatacacacatacaatgtctgctaaagccgaaaagaaaccagcctccaaagccccagctgaaaagaaaccagccgctaaaaagacttccacttccactgatggtaagaagagaagcaaggctagaaaggaaacatactcttcttacatttacaaagttttgaagcaaactcaccctgacactggtatttcccaaaagtccatgtctatcttgaactctttcgttaacgatatctttgaaagaatcgctactgaagcttctaaattggctgcgtataacaagaagtctactatctctgctagagaaattcaaaccgctgttagattgatcttaccaggtgaattggctaagcatgctgtctctgaaggtactagagctgttaccaagtactcttcctctactcaagcataa

SEQ ID NO: 112 - protein, 131 aa, Saccharomyces cerevisiae
MSAKAEKKPASKAPAEKKPAAKKTSTSTDGKKRSKARKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 113 - DNA, 1076 bp, Saccharomyces cerevisiae
tttccccgctaaaataacgccagatgctttctatgcttctaatcttttaccatttacctttgtttatttcaatataaactttaatttacagtccctatctattgcccgactggactaacatgcacgtgacattttgtgatggtttttcgtcccttacttagtacgcttagtacgccacagtttatattttcttgacaataataaagaacctgattgtgggttagaacttgctatacttttagtttaaaataagcaggaaataatcttgagttctgtatcattattataaataaaactatatttgttctctttgtcgccctcggaactttcctcattacattgacgaggtatatatagatatagtagatatacatatctatccatggtatatatgtatgcatctggataattgaatagggtttcatgtcatatgccaagaatttgttaataatatagtggaaaaaagtcaagaggtattataaatttcaaaaaagtaccaaatggaggatcaggatgctgcatttatcaaacaggctacagaagcaatagtggatgtatcattaaatatagataacatagatcctataataaaagagttattagaaagggtaaggaataggcaaaacaggttacaaaataaaaaaccagcactcataccggcagaaaatggtgttgatataaatagtcaaggcggtaacataaaggttaaaaaggaaaacgcattaccaaaaccaccgaagtccagcaaaagcaaaccccaagatcgtagaaatagtactggtgaaaaaagatttaaatgtgcgaaatgttcgttggaattttcaagatcatcagatttgagaaggcacgaaaagacacacttcgccatattgcctaacatttgtcctcaatgtggcaaaggttttgcaaggaaagatgcattgaaaagacattatgatacactgacatgtaggagaaacaggactaaattactaactgcgggtggtgagggtatcaatgaattactgaaaaaagtcaagcaatccaacatcgttcatcgtcaagataacaaccacaatggtagcagtaatggctga

SEQ ID NO: 114 - protein, 191 aa, Saccharomyces cerevisiae
MEDQDAAFIKQATEAIVDVSLNIDNIDPIIKELLERVRNRQNRLQNKKPALIPAENGVDINSQGGNIKVKKENALPKPPKSSKSKPQDRRNSTGEKRFKCAKCSLEFSRSSDLRRHEKTHFAILPNICPQCGKGFARKDALKRHYDTLTCRRNRTKLLTAGGEGINELLKKVKQSNIVHRQDNNHNGSSNG

SEQ ID NO: 115 - DNA, 2048 bp, Saccharomyces cerevisiae
gggaagaactaagagatgttatggctcggagagttttgaaaagcgaaatagattcgctgcaagtttgtgaagaaaccatcgacaagaattacaaggttattcctgatgaaaagctgctaactaatattttaaagagaaagttgacagaggaagaaaaaagctctgtcaaacgtccttgcgtgaagaagtgagcggttgttctaaccactatttaaagccgcaattagtaatgcaaaaagttggccggaattagccgcgcaagttggtggggtcccttaatccgaaaaaggacggctttaacaaatataaactccgaaaatccccacagtgacagaattggagaaacaaccagttttgatatcgccatacatataaagagatgtagaaagcattcttcactgtaatgtccaaatcgtacatttgaatttcttgtaggtttatttaaaaggtaagttaaataaatataatagtacttacaaataaatttggaaccctagaagatgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 116 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 117 - DNA, 668 bp, Saccharomyces cerevisiae
acctttagttcttagcatcaccaatcgcagacatccaacgtatccgtgcgcgtaatccttctcttggtagttgagcacagcatacagaagaagccgcgcgcaagcggtaaatgtctttcctccggccttctaaccaccaaaaccgatctcggaacatgggggggggaaggtcctctgaatcgaaaaacccgagacagcgagagggattttgcagaaaattacaaagatcactatttactgctcccctcacttccgcagtcccctaatagcggaagatgcaatgggtgtgggctctgggtgccctttaaccacgccctcaaaagggggtcctggttattttgcgatgggcgcctctataaatacaaaagaggaagtgagtgtttttgttttggaagagggaaaggaaaaaaagaagaaaatttactatcggttgttgtttttcgccagtataatacaattgattatacattttgaactaaacagcacagcacaatacaacaatggattctgccaagatcattaacattatattatcccttttcttaccaccagtcgccgtttttctagcccgtgggtggggtactgactgtatagtggatatcattttgaccattttggcttggttcccaggtatgctatatgccttgtacattgtcctacaagattaa

SEQ ID NO: 118 - protein, 55 aa, Saccharomyces cerevisiae
MDSAKIINIILSLFLPPVAVFLARGWGTDCIVDIILTILAWFPGMLYALYIVLQD

SEQ ID NO: 119 - DNA, 2213 bp, Saccharomyces cerevisiae
cacttctcagaaatgcatgcagtggcagcacgctaattcgaaaaaattctccagaaaggcaacgcaaaattttttttccagggaataaactttttatgacccactacttctcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatctttcgagatcccctgtaacttattggcaactgaaagaatgaaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaataa

SEQ ID NO: 120 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 121 - DNA, 2213 bp, Saccharomyces cerevisiae
aaaaaaatgttttttaggcaacggagattcgttttatccacgtttaccccacaaaaagtgcaggtacattgtggggccccggcatcgaaaaccagtttttttcctttaaacgctggaaaaaaaggagaaattattggaactttgcagagaatagtccgtaggcaaattgaaaatgttccttaaaaaatttcgtttcttactcattgagattattcagatgccctccgtgccttcattgaaaaaaatccaagagatgtctcggatctgtatgcagattttggcttgcagacaatggagagcaaatgggtatacaatatagaaagcacagaaacatataaaaagagctcgagaaaagacatatggtttgtaactatcttcttcttttttccaatttttctgttttaataataaaaaaacaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaataa

SEQ ID NO: 122 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 123 - DNA, 2204 bp, Saccharomyces cerevisiae
tcttagctatattcttccagcttcgcctgctgcccggtcatcgttcctgtcacgtagtttttccggattcgtccggctcatataataccgcaataaacacggaatatctcgttccgcggattcggttaaactctcggtcgcggattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcatgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 124 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 125 - DNA, 899 bp, Saccharomyces cerevisiae
ctgtcgatattgggttactttgtagtgcattatttccatcaatattagcagtgtcttccaaggtgaaccattgcgtggtaaaccatagagtaaaaaaacaagtggaaatggtatcgattgtataaagtacgcagatttgcgaaaataccagcaagtttggcttatgaatcaaatacagcccttgtgagaatacgattaatgtaaataccgaccaaagatatgctatccattgcataaaatccaacggatgacccgtgaacaatgctaaaataccataagcaccactgcatttgtttagaatggaaatacctaagacaatctcaactgcaaggtatagcggcataaaccccaaaaaagactatgaaaaaaaaatatgtttgagaacaggttagtaaaattgtgctttgcttcgaatccttacaagttaacaaaaatttatagcgtttgccggaaacatacttttggaagggttagaagagatgatctcataactaaggttaatggttacaattggtagttcctccctggtattatttcttttcttcgtagtttttgtacagatcacttatacagctttacacagattttcccgcttgttgtgcacttttttttcgaagattattgaagagggatgcgtttggtacaataaaaaacataggttcccaaacctatataaatatatatatgtatatgtatatatactacatatatgctttgagaaatatgtgaatgttgagataattgttgggattccattgttgataaaggctataatattaggtatacagaatatactagaagttctcctcaaggatttaggaatccataaaagggaatctgcaattctacacaattctataaatattattatcatcattttatatgtttatattcattga

SEQ ID NO: 126 - protein, 132 aa, Saccharomyces cerevisiae
MVTIGSSSLVLFLFFVVFVQITYTALHRFSRLLCTFFSKIIEEGCVWYNKKHRFPNLYKYIYVYVYILHICFEKYVNVEIIVGIPLLIKAIILGIQNILEVLLKDLGIHKRESAILHNSINIIIIILYVYIH

SEQ ID NO: 127 - DNA, 806 bp, Saccharomyces cerevisiae
aatacaagacttggtggtcagcggagcgctatccttagagaattctatcgacctctctaatatcaagcacaccacatggaaggattgggaaagaatcaacaagaaggaattgcttcggggcaaaaaggaacacaaaactcggtcaaagtttttaacttttgaagagttgtggaacggtgtagaaggcatataaaatagatcgttaatatatttctaacatcttcttgtaaatgtaaatattttaaaagggttgatcttattacggagagaaccaatcatatcgaaggatttctcaatagtaagtatcccgcgcgtggtcctcggggaaatagaacgagaaacttcaagtacttgatagcaagaaagtgagtgcttggcttccccattttgattataaagaaaggcattattttctagggcaagaaaagacattgttgaaattgttccagaaactttcatttaaagtctttcgtgaaaggagtggacgtcaaaaagaaataatgatttttaaacgtgcagtatctacattgattcctccaaaagttgtgtcttccaagaatataggttcggcaccaaatgccaagcgcattgctaatgttgttcacttttataagtctttgcctcaaggaccagcaccagccatcaaggctaacactagattggccagatacaaagccaagtactttgatggggataatgctagtggtaaaccattgtggcattttgctctaggtataattgcctttggctattccatggaatattattttcatttgagacatcataaaggtgcggaagagcattga

SEQ ID NO: 128 - protein, 101 aa, Saccharomyces cerevisiae
MIFKRAVSTLIPPKVVSSKNIGSAPNAKRIANVVHFYKSLPQGPAPAIKANTRLARYKAKYFDGDNASGKPLWHFALGIIAFGYSMEYYFHLRHHKGAEEH

SEQ ID NO: 129 - DNA, 1166 bp, Saccharomyces cerevisiae
tcgtttatcctttttgaactgcatctggcatcgttaacagtaaggccatctggaacatcaagcaagcactccacttttacgtcacaaccatagttggttaactaagaaaagacagtacatatttcccttccgagtcacttattttttttttcttctgaaaaaattaattagattaatttcaattaatatcatttccgcttatctgacttctttcattttttttctctatatttcgcgtttactaggaaagaaaaggaaaaaaaatttttccccctccatctgtcccaaatcgggtagcgatgagctgctatagaattttctatttaaacatgtttgataagcccaatttccgttagattttgttcccccttcgcagtttggtttgccgtaacttttttattttagtctccatctagctggagtaatacgatgtagtgccttgtaatctttcttatttttatattaccgttcgtgttcattatatccattacgttcccataatgtcggcaaacgataagcaatacatctcgtacaacaacgtacatcaactatgtcaagtatccgctgagagaattaagaatttcaagccggacttaatcattgccattggtggtggtggtttcattcctgctaggatcctacgtacgttcctaaaggagcccggcgtgccaaccatcagaatttttgctattattttgtctttgtacgaagatttgaacagtgtaggctcagaagttgaggaagttggtgttaaggttagcagaacacaatggattgattacgagcaatgtaaattagatctagtcggcaagaacgttcttatcgttgacgaagtcgatgacacccgtaccacacttcattacgctttgagtgaattggaaaaggatgcagctgaacaggcaaaggctaaaggtatcgatactgaaaagtctccagagatgaaaacaaacttcgggatttttgttctacacgataagcaaaaaccaaagaaagcagatttgcctgccgaaatgttgaatgacaagaaccgttattttgcagctaaaactgttccagacaagtggtatgcatatccatgggaatctactgacattgttttccatactagaatggctattgaacagggcaatgacatctttattcctgagcaggaacacaagcaatga

SEQ ID NO: 130 - protein, 221 aa, Saccharomyces cerevisiae
MSANDKQYISYNNVHQLCQVSAERIKNFKPDLIIAIGGGGFIPARILRTFLKEPGVPTIRIFAIILSLYEDLNSVGSEVEEVGVKVSRTQWIDYEQCKLDLVGKNVLIVDEVDDTRTTLHYALSELEKDAAEQAKAKGIDTEKSPEMKTNFGIFVLHDKQKPKKADLPAEMLNDKNRYFAAKTVPDKWYAYPWESTDIVFHTRMAIEQGNDIFIPEQEHKQ

SEQ ID NO: 131 - DNA, 998 bp, Saccharomyces cerevisiae
tgcactgtggatgtttgggttgtgtattttgctttcataacatacagatattttgtttaaggaagtgaaataaacaatatcataaaacaggtacttcatagaccataaagcataacccagattatcctcttagatagcaatgctaatgtaaacagagatccgtttgcgtgactttatactaatatgatatgtctacttcgctttgtgttcgagcagcctggcagtcccctctagccgcttttttccctttccgaaggtttccgcctaagccccctggctctaggccgagaaaatgttaatgctccttctacgagaaaatgcttgtcgccacaccaggacaggtgctcgacgacgcttccgctaatctttctcaatgttgtatcttctttggcggtacattactagtatgaaaatggaataaaaacagtacctaaattatttacttacttcccgttaaagcaaccccaagtgcccaatagaaggataaatcaatagtcaatatgcctccaaagtttgatccaaatgaagttaagtacttgtacttgagagctgtcggtggtgaagtcggtgcttccgccgccttggctccaaagatcggtccattgggtttatccccaaagaaggttggtgaagatatcgccaaggccaccaaggaattcaaaggtatcaaagttactgtccaattgaaaatccaaaacagacaagctgctgcttctgttgttccatctgcttcctctttggtcattactgctttgaaggaaccaccaagagacagaaagaaggataagaacgtcaagcatagcggtaacatccaattggatgaaattattgaaattgccagacaaatgagagacaaatccttcggtagaactttggcttccgttactaaggaaattttgggtactgctcaatctgtcggttgtcgtgttgatttcaagaaccctcatgacatcattgaaggtattaacgctggtgaaattgaaattccagaaaactaa

SEQ ID NO: 132 - protein, 165 aa, Saccharomyces cerevisiae
MPPKFDPNEVKYLYLRAVGGEVGASAALAPKIGPLGLSPKKVGEDIAKATKEFKGIKVTVQLKIQNRQAAASVVPSASSLVITALKEPPRDRKKDKNVKHSGNIQLDEIIEIARQMRDKSFGRTLASVTKEILGTAQSVGCRVDFKNPHDIIEGINAGEIEIPEN

SEQ ID NO: 133 - DNA, 932 bp, Saccharomyces cerevisiae
tctccctctcctgccatataaccccactggtattttccaatgccttattgttggaaacctgatctttataccattcctgcactttcacagggtcattgccgtggataatacaaaacttgaatttggacacctgcttgtcacatgatgtaaaatctccatatctgtaatagcttctaaattgccctccaatcgaatagcaactcgtcagttgatcaaatgcctctcggcaactcatcgttgtcggatattttgtactcatcctttcctgtttcttcctcaagctgctctcttttaccctaatagaaccatcgcctccctcttgatttatgctaataccacatccaatagcagaactattactaagatccgatatttcggcccccttcgcaaaggggcccgccgcactttcttcatgaattttcatataaaaagtcccaggacgccaagaaaaggtgccctcttgattaacggacactccaactactgttatatattgtttcatggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatag

SEQ ID NO: 134 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 135 - DNA, 929 bp, Saccharomyces cerevisiae
taaagtagtcggtacgtactttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacacaccacaccacacccacacacaccacaccacacccaccacacccacaccacacccacacccacaccacacccacacacccacacacccacaccagagagaagcctaagcctaagactaagacaagccaagcctgaccaacctgtctctcaaattaccctccattaccctacctccccactcgttaccctgactcattcaactataccaccccaaccaccatccatctccctgtgtactaccaccaaccgaccgtccaccataaccgttaccctccaattacccatatccaactccactaccacttaccctaccatctcccatctactactcaccatactattgttctacccaccactattgaaacgctaa

SEQ ID NO: 136 - protein, 142 aa, Saccharomyces cerevisiae
MSLRPCLTPSSMQYSDIYIHTTPHPHTPHHTHHTHTTPTPTPHPHTHTPTPERSLSLRLRQAKPDQPVSQITLHYPTSPLVTLTHSTIPPQPPSISLCTTTNRPSTITVTLQLPISNSTTTYPTISHLLLTILLFYPPLLKR

SEQ ID NO: 137 - DNA, 5891 bp, Saccharomyces cerevisiae
ttctattatattggtcttttcgagagcggaagaagttgtaggctaagcgcaggctaagcgtaggtccatatttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgggacagacagtcgcttatcttagtgagatttcttattaactgaattttctttgctgctgctggagatttgcacctgcatagcgcagattctgcttcttctcaatagagtagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccctacatgttcttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaagaccgattgggtgatattttgcatattatcttgcgagcatgtgcgctcaatttcggggcgggtccccgtggtggcgctggtgacgaagaggatcgatctattacgaatgaagaacccattattccctctgtggacgagcatggcttgaaagtatgtaagttgcgtagtcctaacactccacgaagactcagaaaaacactagatgccgtgaaagctttattggtgtcgtcttgtgcttgtactgcaagggatttagatatatttgatgacaccaacggcgttgcaatgtggaaatggatcaaaattctgtaccacgaagtagcgcaggaaaccacgctgaaggactcttatagaataactttggtaccttcttctgatggtatatcagtatgtggaaaactttttaatcgcgagtatgtccgcggcttttactttgcatgcaaggctcagttcgataacctttggggagagttgaacaactgcttttatatgcctacagtggttgatattgccagcctcattttgcgtaatcgagaagttttgttcagagagccaaagcgaggaattgacgagtatctggaaaacgattcttttcttcaaatgatacctgttaaatatcgtgaaattgtgctgcccaagttgagaagagatactaacaaaatgaccgcggctcttaaaaataaagtcactgttgcaattgacgagcttacggtgccacttatgtggatggtccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcattgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgattaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtga

SEQ ID NO: 138 - protein, 1796 aa, Saccharomyces cerevisiae
MKVSDRRKFEKANFDEFESALNNKNDLVHCPSITLFESIPTEVRSFYEDEKSGLIKVVKFRTGAMDRKRSFEKIVISVMVGKNVQKFLTFVEDEPDFQGGPIPSKYLIPKKINLMVYTLFQVHTLKFNRKDYDTLSLFYLNRGYYNELSFRVLERCHEIASARPNDSSTMRTFTDFVSGAPIVRSLQKSTIRKYGYNLAPYMFLLLHVDELSIFSAYQASLPGEKKVDTERLKRDLCPRKPIEIKYFSQICNDMMNKKDRLGDILHIILRACALNFGAGPRGGAGDEEDRSITNEEPIIPSVDEHGLKVCKLRSPNTPRRLRKTLDAVKALLVSSCACTARDLDIFDDTNGVAMWKWIKILYHEVAQETTLKDSYRITLVPSSDGISVCGKLFNREYVRGFYFACKAQFDNLWGELNNCFYMPTVVDIASLILRNREVLFREPKRGIDEYLENDSFLQMIPVKYREIVLPKLRRDTNKMTAALKNKVTVAIDELTVPLMWMVHFAVGYPYRYPELQLLAFAGPQRNVYVDDTTRRIQLYTDYNKNGSSEPRLKTLDGLTSDYVFYFVTVLRQMQICALGNSYDAFNHDPWMDVVGFEDPDQVTNRDISRIVLYSYMFLNTAKGCLVEYATFRQYMRELPKNAPQKLNFREMRQGLIALGRHCVGSRFETDLYESATSELMANHSVQTGRNIYGVDSFSLTSVSGTTATLLQERASERWIQWLGLESDYHCSFSSTRNAEDVVAGEAASSDHDQKISRVTRKRPREPKSTNDILVAGQKLFGSSFEFRDLHQLRLCHEIYMADTPSVAVQAPPGYGKTELFHLPLIALASKGDVKYVSFLFVPYTVLLANCMIRLSRCGCLNVAPVRNFIEEGCDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGAAEKVSRTKEFVTDGSMRVLIGTKLVTEGIDIKQLMMVIMLDNRLNIIELIQGVGRLRDGGLCYLLSRKNSWAARNRKGELPPIKEGCITEQVREFYGLESKKGKKGQHVGCCGSRTDLSADTVELIERMDRLAEKQATASMSIIALPSSFQESNSSDRCRKYCSSDEDSDTCIHGSANASTNATTNSSTNATTTASTNVRTSATTTASINVRTSAITTESTNSSTNATTTASTNVRTSATTTASINVRTSATTTESTNSNTSATTTESTDSNTSATTTESTDSNTSATTTASTNSSTNATTTASTNSSTNATTTESTNASAKEDANKDGNAEDNRFHPVTDINKESYKRKGSQMVLLERKKLKAQFPNTSENMNVLQFLGFRSDEIKHLFLYGIDVYFCPEGVFTQYGLCKGCQKMFELCVCWAGQKVSYRRMAWEALAVERMLRNDEEYKEYLEDIEPYHGDPVGYLKYFSVKRGEIYSQIQRNYAWYLAITRRRETISVLDSTRGKQGSQVFRMSGRQIKELYYKVWSNLRESKTEVLQYFLNWDEKKCREEWEAKDDTVFVEALEKVGVFQRLRSMTSAGLQGPQYVKLQFSRHHRQLRSRYELSLGMHLRDQLALGVTPSKVPHWTAFLSMLIGLFYNKTFRQKLEYLLEQISEVWLLPHWLDLANVEVLAADNTRVPLYMLMVAVHKELDSDDVPDGRFDIILLCRDSSREVGE

SEQ ID NO: 139 - DNA, 1346 bp, Saccharomyces cerevisiae
agtttcactagcgaattatacaactcaccagccacacagctcactcatctacttcgcaatcaaaacaaaatattttattttagttcagtttattaagttattatcagtatcgtattaaaaaattaaagatcattgaaaaatggcttgctaaaccgattatattttgtttttaaagtagattattattagaaaattattaagagaattatgtgttaaatttattgaaagagaaaatttattttcccttattaattaaagtcctttactttttttgaaaactgtcagttttttgaagagttatttgttttgttaccaattgctatcatgtacccgtagaattttattcaagatgtttccgtaacggttacctttctgtcaaattatccaggtttactcgccaataaaaatttccctatactatcattaattaaatcattattattactaaagttttgtttaccaatttgtctgctcaagaaaataaattaaatacaaataaaatgtccgaatatcagccaagtttatttgctttaaatccaatgggtttctcaccattggatggttctaaatcaaccaacgaaaatgtatctgcttccacttctactgccaaaccaatggttggccaattgatttttgataaattcatcaagactgaagaggatccaattatcaaacaggataccccttcgaaccttgattttgattttgctcttccacaaacggcaactgcacctgatgccaagaccgttttgccaattccggagctagatgacgctgtagtggaatctttcttttcgtcaagcactgattcaactccaatgtttgagtatgaaaacctagaagacaactctaaagaatggacatccttgtttgacaatgacattccagttaccactgacgatgtttcattggctgataaggcaattgaatccactgaagaagtttctctggtaccatccaatctggaagtctcgacaacttcattcttacccactcctgttctagaagatgctaaactgactcaaacaagaaaggttaagaaaccaaattcagtcgttaagaagtcacatcatgttggaaaggatgacgaatcgagactggatcatctaggtgttgttgcttacaaccgcaaacagcgttcgattccactttctccaattgtgcccgaatccagtgatcctgctgctctaaaacgtgctagaaacactgaagccgccaggcgttctcgtgcgagaaagttgcaaagaatgaaacaacttgaagacaaggttgaagaattgctttcgaaaaattatcacttggaaaatgaggttgccagattaaagaaattagttggcgaacgctga

SEQ ID NO: 140 - protein, 281 aa, Saccharomyces cerevisiae [sequence omitted]

SEQ ID NO: 141 - DNA, 842 bp, Saccharomyces cerevisiae
agtaattgtctcccatttttggtatacgagctagcaggaccttttgcccaatgaccattccatattcatcccactcaccaccgtcatcgttggtattattattatcattccgcttgaagaaaaagaaacgaaaaaagaaatggatcagcagccgggttatagcgccccttattgaattattttccttcgtgccttctctgagaagggtctgcagtcccccgccgaggggtcttttcccaccttctcaaagctaatagcgataatagcgagggcatttattcaagttccaactactataagtggccgcaaggggcaaagacaaaggcacacaacatatatatatatcgtgttgtgaagctcgagaagattagatcagaatagttctctttttgttgaggttgaaacaaaatcaaagacttatacaagaagatcacatacaagcatttattcacattactttaagtaaacttcagtaaactacattacatcataaacaaaacatggctaaagaaagtacgggattcaaaccaggctctgcaaaaaagggtgctacattgtttaaaacgaggtgtcagcagtgtcatacaatagaagagggtggtcctaacaaagttggacctaatttacatggtatttttggtagacattcaggtcaggtaaagggttattcttacacagatgcaaacatcaacaagaacgtcaaatgggatgaggatagtatgtccgagtacttgacgaacccaaagaaatatattcctggtaccaagatggcgtttgccgggttgaagaaggaaaaggacagaaacgatttaattacttatatgacaaaggctgccaaatag

SEQ ID NO: 142 - protein, 113 aa, Saccharomyces cerevisiae
MAKESTGFKPGSAKKGATLFKTRCQQCHTIEEGGPNKVGPNLHGIFGRHSGQVKGYSYTDANINKNVKWDEDSMSEYLTNPKKYIPGTKMAFAGLKKEKDRNDLITYMTKAAK

SEQ ID NO: 143 - DNA, 1991 bp, Saccharomyces cerevisiae
tagcttgacctggtcagattaatcagcttccaacgttacttccctttcgcaagaatctacccaaaatgtctcgagcatcttgataattacagtatcgttcgtcccgacttggcatttgtttaaatttctaagatgcttcctataggaacataattgtcaagaaagcacaacaaattgtctgcaatgtcaacaggagtggcgcattttatgttttttcatttttttttttttgtgcgtgatcattaagcgggatattgtccacagtcatctaaaagaatgaccatttcgacgacttagttcggaaaatatttccagcggatgacaccacttgccacagttggtgaccgccaaatctaagtcacgcgcggaaactgaaaggttgtgagtatataagtgatcactcgcttatataactgacgaggcagaacagggtgccaaaatgctcctcaatattttattcatttgagattcaaggcttaaagacagcatatataagaattatgacggccgcacatcctgttgctcagttaactgccgaggcataccctaaagtcaagagaaacccaaatttcaaagttctcgactcggaagatttggcgtactttcgttcgattttgtcaaatgatgaaatcttaaactctcaagctccagaagagcttgcttcgtttaaccaggactggatgaaaaaatatagaggccagtccaatttaattctcttgccaaactccactgataaagtgtccaagattatgaaatactgtaacgataaaaagttggcagtagtaccacaaggtggtaacaccgacttggtcggagcctctgttccggtatttgatgagattgttctttctctaagaaatatgaacaaagtcagagattttgatccagttagcgggactttcaagtgtgacgcgggtgtcgttatgcgtgatgcgcatcaatttttacacgaccatgaccatatcttcccattggatctgccttctagaaacaactgtcaagtgggcggtgtagtttcaacaaatgcaggtggtttgaactttttaagatatgggtctctacacggtaatgttttgggtttggaagtggtgctacccaacggtgagattatcagcaatatcaatgccctaaggaaggacaatactggttatgacttgaaacaattattcatcggtgcagagggtactatcggtgtcgttactggtgtatccatagttgcagcagcaaagccaaaagccttgaatgccgtattttttggtattgagaatttcgataccgttcagaaattatttgtcaaggctaaaagtgaattatctgagattttatctgcttttgaattcatggaccgtggctccattgaatgtacgatagaatacttgaaggacttgcctttccctctggagaaccaacacaacttttatgttcttattgaaacgtcagggtccaataagagacacgacgatgagaagctgactgctttcctcaaagataccacagattctaaattaatttcggagggtatgatggctaaggacaaagccgattttgatagactttggacctggagaaaatctgttccaacagcttgtaattcttacggtggtatgtacaagtatgacatgtcacttcaattgaaagatttatattccgtatctgcggctgtgacggagagattaaacgcagccggtttgattggtgatgcaccaaaaccagttgttaaatcatgtggttatggtcatgtcggtgacggaaacatccatttaaatatcgcggtaagagaatttacaaaacagattgaggacttactagaaccatttgtttatgaatatattgcatcaaagaaaggttccatcagtgctgagcatgggatcggtttccataagaaaggtaagttacactacaccagaagtgatattgaaattagatttatgaaggatatcaaaaatcactacgatccaaatggaatcttaaacccatacaagtacatttga

SEQ ID NO: 144 - protein, 496 aa, Saccharomyces cerevisiae
MTAAHPVAQLTAEAYPKVKRNPNFKVLDSEDLAYFRSILSNDEILNSQAPEELASFNQDWMKKYRGQSNLILLPNSTDKVSKIMKYCNDKKLAVVPQGGNTDLVGASVPVFDEIVLSLRNMNKVRDFDPVSGTFKCDAGVVMRDAHQFLHDHDHIFPLDLPSRNNCQVGGVVSTNAGGLNFLRYGSLHGNVLGLEVVLPNGEIISNINALRKDNTGYDLKQLFIGAEGTIGVVTGVSIVAAAKPKALNAVFFGIENFDTVQKLFVKAKSELSEILSAFEFMDRGSIECTIEYLKDLPFPLENQHNFYVLIETSGSNKRHDDEKLTAFLKDTTDSKLISEGMMAKDKADFDRLWTWRKSVPTACNSYGGMYKYDMSLQLKDLYSVSAAVTERLNAAGLIGDAPKPVVKSCGYGHVGDGNIHLNIAVREFTKQIEDLLEPFVYEYIASKKGSISAEHGIGFHKKGKLHYTRSDIEIRFMKDIKNHYDPNGILNPYKYI

SEQ ID NO: 145 - DNA, 2429 bp, Saccharomyces cerevisiae
actattgtcacttctccattgagattcgaaaaacccctcgggtcttgttagaactaaattacgttcataggggtgggatttatattgtaattccgcgaggtttacacgaaagatatctcaactctagccgcacatccattccggtatgtactctcccaccattgggtattatagaatgtaataggtttcaaagcggatatcttttgcccggtgagttgttactttttcattcgagcaatgaagtacattctagaagttcctagaaccttatggaagcaccaagaaaaaaggaagttaaacaaaacactgattcaataagcaaggggggaagctccttagtttgacgacagtaacaaaatgttcgtataaattgaacgaaactcaagccaataaaggacttttcagaggcctatctcttctttctccacaactttcgaataaaaaccactaataaaaagtaaataacaaaaacaagaaaaaaaataaacaaaacaataatcatgtcaaaagctgttggtattgatttaggtacaacctattcatgtgttgctcattttgcaaacgatagggttgaaattatcgctaacgatcaaggtaatagaacgacgccttcttatgtggcttttactgacacagaaaggctaattggtgacgctgcgaagaatcaagctgcgatgaacccacataatacagtattcgatgctaagcgtctgatcggacgtaaattcgatgatccagaagtgacgaacgatgctaagcattacccattcaaagtgattgacaagggaggtaaaccggtagtgcaagtggaatataaaggcgagacaaagacatttactccagaagaaatttcctcaatgatcttgacaaagatgaaggagactgctgagaactttttaggaacagaagtgaaagatgctgtagtaacggttccagcctatttcaacgattcacaaaggcaagcaacaaaagatgccggtacaatcgcgggcttgaacgttcttcgtatcattaatgaacctacagctgccgctattgcgtatgggctggacaagaaatcgcagaaggagcacaacgtcttgatctttgatttaggtggtggtacttttgatgtctctctgctatccatagatgaaggtgtctttgaggttaaggctactgctggtgacactcacttgggtggtgaagatttcgatagtaggctggttaactttctagccgaggagttcaaaagaaaaaataaaaaggatctaacaactaaccaaaggtccctaaggaggttaaggaccgccgctgaaagggccaagagaactctgtcttcgtctgctcagacatctatagaaatagattcattatttgagggtatcgatttctatacttccattacaagggcaagatttgaagaattatgtgctgatttgtttagatctacattggagccagtggaaaaagttttggctgattcaaaattagataagtcacaaattgatgaaattgtacttgttggtggttcaacaagaattccaaaagtacaaaaactggtttctgattttttcaatggtaaagaaccaaaccgttcgattaaccctgatgaggccgtcgcttatggtgctgccgtacaggctgccatcttaacgggtgaccagtcgtcgacgacccaagatttactgttgctggatgttgcaccattatctctaggtattgaaactgcaggtggtattatgacaaagttgatcccaagaaattcgactatcccaacaaaaaaatcggaagtgttttccacctacgctgacaaccaacctggtgtgttgatacaagtttttgagggtgaaaggacaaggacaaaagacaacaatctactgggtaaatttgagttgagcggtattccacccgctccaagaggcgtaccacaaattgaagttacatttgatatcgatgcaaatggtattctgaacgtatctgccgttgaaaaaggtactggtaaatctaacaagattacaattactaacgataagggaagattatcgaaggaagatatcgataaaatggttgctgaggcagaaaagttcaaggccgaagatgaacaagaagctcaacgtgttcaagctaagaatcagctagaatcgtacgcgtttactttgaaaaattctgtgagcgaaaataacttcaaggagaaggtgggtgaagaggatgccaggaaattggaagccgccgcccaagatgctataaattggttagatgcttcgcaagcggcctccaccgaggaatacaaggaaaggcaaaaggaactagaaggtgttgcaaaccccattatgagtaaattttacggagctgcaggtggtgccccaggagcaggcccagttccgggtgctggagcaggccccactggagcaccagacaacggcccaacggttgaagaggttgattag

SEQ ID NO: 146 - protein, 642 aa, Saccharomyces cerevisiae
MSKAVGIDLGTTYSCVAHFANDRVEIIANDQGNRTTPSYVAFTDTERLIGDAAKNQAAMNPHNTVFDAKRLIGRKFDDPEVTNDAKHYPFKVIDKGGKPVVQVEYKGETKTFTPEEISSMILTKMKETAENFLGTEVKDAVVTVPAYFNDSQRQATKDAGTIAGLNVLRIINEPTAAAIAYGLDKKSQKEHNVLIFDLGGGTFDVSLLSIDEGVFEVKATAGDTHLGGEDFDSRLVNFLAEEFKRKNKKDLTTNQRSLRRLRTAAERAKRTLSSSAQTSIEIDSLFEGIDFYTSITRARFEELCADLFRSTLEPVEKVLADSKLDKSQIDEIVLVGGSTRIPKVQKLVSDFFNGKEPNRSINPDEAVAYGAAVQAAILTGDQSSTTQDLLLLDVAPLSLGIETAGGIMTKLIPRNSTIPTKKSEVFSTYADNQPGVLIQVFEGERTRTKDNNLLGKFELSGIPPAPRGVPQIEVTFDIDANGILNVSAVEKGTGKSNKITITNDKGRLSKEDIDKMVAEAEKFKAEDEQEAQRVQAKNQLESYAFTLKNSVSENNFKEKVGEEDARKLEAAAQDAINWLDASQAASTEEYKERQKELEGVANPIMSKFYGAAGGAPGAGPVPGAGAGPTGAPDNGPTVEEVD

SEQ ID NO: 147 - DNA, 1064 bp, Saccharomyces cerevisiae
tactgaagtccctctaaacctactgccttttatttttaggctctaaaataaccatggacaacgtgaattgggtagcatcttttttttaatagatagtttattatgtataacaataatttaaagatattcatagtgataagtaattttaaatgagtttaaagtactacttttcctttaccgccagtttcctgtactatgaaaaaggcaaattccgcattgtagccgcccacacgcattttgatcatcaattacgaaatttgccgcacacgtgtcacgtgataagcactcttactatcatgttttacggagtagcaatgatgttcaattattgcagctttctttcgtgaaatcgtagtatcatagaccttcctaatgatggaagcggtaaagaaggaaatcgtaaaagtaaattaacgaagtagtattagtaaaacagagttgaaaaactgataaatcttcaactcgaactgaaaagaaacacaatagaatattttttctcaatgctacctttatatcttttaacaaatgcgaagggacaacaaatgcaaatagaattgaaaaacggtgaaattatacaagggatattgaccaacgtagataactggatgaaccttactttatctaatgtaaccgaatatagtgaagaaagcgcaattaattcagaagacaatgctgagagcagtaaagccgtaaaattgaacgaaatttatattagagggacttttatcaagtttatcaaattgcaagataatataattgacaaggtcaagcagcaaattaactccaacaataactctaatagtaacggccctgggcataaaagatactacaacaatagggattcaaacaacaatagaggtaactacaacagaagaaataataataacggcaacagcaaccgccgtccatactctcaaaaccgtcaatacaacaacagcaacagcagtaacattaacaacagtatcaacagtatcaatagcaacaaccaaaatatgaacaatggtttaggtgggtccgtccaacatcattttaacagctcttctccacaaaaggtcgaattttaa

SEQ ID NO: 148 - protein, 187 aa, Saccharomyces cerevisiae
MLPLYLLTNAKGQQMQIELKNGEIIQGILTNVDNWMNLTLSNVTEYSEESAINSEDNAESSKAVKLNEIYIRGTFIKFIKLQDNIIDKVKQQINSNNNSNSNGPGHKRYYNNRDSNNNRGNYNRRNNNNGNSNRRPYSQNRQYNNSNSSNINNSINSINSNNQNMNNGLGGSVQHHFNSSSPQKVEF

SEQ ID NO: 149 - DNA, 947 bp, Saccharomyces cerevisiae
atacgggggaagaagaaatatcatattcaaagctaattcattgaaattagtgcttgtctcatctagcctttagtgcttaatctctggaggagcacatatggggttaaagccatgccgggactgggggcccctatcggggctcgaacccgaatcccgcgagtatttatttgaaggtccgggacgcaagttacctaatctggttaattgatatcccatttaggcgatgacgttccttcccctcacccctcggcttgttagaagatctattgttatagcctcctctggaagaatttatgccagatgaagaaaaaaacttctcgaagttcccagatgcccaaatgagggctttccatccctgttagctggaaaagtgtaagtatatctatataaaaagtcggcctacttttgccaggttcgtctttcacttgcactctcttgatcttactttctactcaaaaagaatccaatacacaaaaataaaatcagtactattactaataatgttgtctaacgctaagctccttctatcattggccatggcctctacggctctcggattggtatctaattctagttcctctgtaatcgtggtaccatcaagcgatgctactattgccggtaacgatacagccacgccagcaccagagccatcatccgccgctccaatattctacaactcgactgctactgcaacacagtacgaagttgtcagtgaattcactacttactgcccagaaccaacgactttcgtaacgaatggcgctacattcactgttactgccccaactacgttaacaattaccaactgtccttgcactatcgagaagcctacttcagaaacatcggtttcttctacacatgatgtggagacaaattctaatgctgctaacgcaagagcaatcccaggagccctaggtttggctggtgcagttatgatgcttttatga

SEQ ID NO: 150 - protein, 148 aa, Saccharomyces cerevisiae
MLSNAKLLLSLAMASTALGLVSNSSSSVIVVPSSDATIAGNDTATPAPEPSSAAPIFYNSTATATQYEVVSEFTTYCPEPTTFVTNGATFTVTAPTTLTITNCPCTIEKPTSETSVSSTHDVETNSNAANARAIPGALGLAGAVMMLL

SEQ ID NO: 151 - DNA, 1304 bp, Saccharomyces cerevisiae
agatagatagatatagatagataatggacgtagttatagaacagaaaatcggtagatcgaaaacacaggggaaaaaggggggggggggggggagacagcgcagccacgtgacgggcttcctctttggaaagtggagcgaagttttgcggaagctactttattccggcctggagtcaaaagaggaagctcggtggcaaatagcttcctctttgtggccggggcgcggggggacgaggcaaaaagcaaagaaaagcaaaaaaaataaaaaaaaaaacaaaaaaacaggggtatgagaaaaagacacgcttttccacgcgcagcaaaaaggaaaaaggaaaaggaaactctttattattggaccttaaacctgaaaacgagacgaaccgtaacataaaaccgtgtagtttctgcaaaaataacttagtttttcctacttttcaaaattgagagcgcaagcaagtgagaagaaaaagcaagttaaagataaactaaagataaaaatgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttggccaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaa

SEQ ID NO: 152 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 153 - DNA, 2000 bp, Saccharomyces cerevisiae
gaaaaatttcaacggtggtgtcttaatggtttcccatgatatctctgttattgactctgtttgtaaagagatttgggtttcagagcaaggtactgtcaagaggttcgaaggtacaatttacgactatagagattacatcttgcagtctgctgatgctgcaggtgtggttaaaaagcattgattatttaggaagcacctcagaatatattttccatagaagcctaaattaagtatgcattcatagccccatgatacttttttttttgactacttgtattggaatctaattgacctaactgggcattctgggtcattggtatatgtatcactttttacgtaaaaaagtagtggctaatataaaacataaaatctacaagaagggtgaagtgcttttcgaattttgccactgcaagtaattggtgcaattgaaatacgagatttcgttctctaagaggatataaaaataaggaaattagccctacctatccttgtgttaaaatatgagcggagaaacgtttgagttcaatattagacattctggtaaagtttacccaataacactttccactgatgctacttcagcagatttgaaaagcaaagcagaggaattgacccaagtcccaagtgcccgccaaaaatacatggttaaaggtggcttgtctggcgaagagtccattaaaatatatcccttaatcaagccaggatcgacagtaatgctattggggactccagatgctaacctgatttctaaaccagccaaaaagaataatttcattgaagaccttgcgcctgagcaacaagtccaacaatttgctcaattgcctgttggtttcaagaatatgggcaacacctgttatctgaatgctaccctacaggctttatacagagtgaacgatttaagggatatgattcttaattataacccttctcaaggtgtgtctaacagtggtgcacaagatgaagagattcacaaacaaatcgttattgaaatgaagcgttgttttgaaaatttacagaataaaagtttcaagagtgttttgccaattgtgttattaaacacgctaagaaagtgttatccacaatttgctgaacgtgattcacaaggtgggttctataaacagcaagacgctgaggagttgtttacacaactattccatagtatgagtattgtttttggtgacaaattttccgaagatttcaggattcaatttaaaactaccatcaaagacacagctaatgataacgatattactgttaaagaaaatgaaagcgattctaaattacaatgtcatatttctggtactacaaatttcatgagaaatgggctcctggaaggtttgaatgagaaaattgaaaaaagatcagacttgactggcgccaattccatctatagcgtcgaaaagaaaatatcaagattaccaaagtttttaactgttcagtacgttagatttttctggaaaaggtcaaccaacaaaaaatctaaaatattgcgtaaggtcgttttcccatttcaattagatgttgcagacatgcttaccccagaatacgcagcagagaaggtaaaagttcgtgacgaactgagaaaagttgaaaaggagaaaaatgaaaaggaaagagagatcaaaaggcgtaaatttgacccatcatccagtgaaaatgtcatgacaccaagagaacaatatgagacacaagtggctcttaacgaaagtgaaaaagatcaatggctcgaagagtataagaaacattttcctccaaacttggaaaaaggtgaaaacccatcttgtgtttataacttgatcggtgtcattacacatcaaggtgccaattctgagtctggacactatcaagctttcataagggacgaactggacgaaaataaatggtacaaatttaatgatgataaagttagcgttgttgaaaaggaaaaaattgaatctttagccggtgggggcgaaagtgatagtgcactgatcttaatgtataaaggatttggtctgtaa

SEQ ID NO: 154 - protein, 499 aa, Saccharomyces cerevisiae
MSGETFEFNIRHSGKVYPITLSTDATSADLKSKAEELTQVPSARQKYMVKGGLSGEESIKIYPLIKPGSTVMLLGTPDANLISKPAKKNNFIEDLAPEQQVQQFAQLPVGFKNMGNTCYLNATLQALYRVNDLRDMILNYNPSQGVSNSGAQDEEIHKQIVIEMKRCFENLQNKSFKSVLPIVLLNTLRKCYPQFAERDSQGGFYKQQDAEELFTQLFHSMSIVFGDKFSEDFRIQFKTTIKDTANDNDITVKENESDSKLQCHISGTTNFMRNGLLEGLNEKIEKRSDLTGANSIYSVEKKISRLPKFLTVQYVRFFWKRSTNKKSKILRKVVFPFQLDVADMLTPEYAAEKVKVRDELRKVEKEKNEKEREIKRRKFDPSSSENVMTPREQYETQVALNESEKDQWLEEYKKHFPPNLEKGENPSCVYNLIGVITHQGANSESGHYQAFIRDELDENKWYKFNDDKVSVVEKEKIESLAGGGESDSALILMYKGFGL

SEQ ID NO: 155 - DNA, 944 bp, Saccharomyces cerevisiae
atcgagccattcgcggtcgctgagtaagcgacggtcatcgggcgcgctcgtggacgatgacaagcgcgaatcacacaagcatgcagagcaagcacggcgtaatcgattagcggtcgcgctgcacgaactggcgtctttaatccccgcggagtggaaacagcaaaatgtgtcggccgcgccgtccaaagcgaccaccgtggaggcggcctgccggtacatccgtcacctacagcagaacgtgagcacgtgaccgtgcaccaatgggaagcacgttccgggcatatcggactggggcgcgcctcccctgcgcggtgcttgttataagaggcgctttgctggaaagtggcccacaccgggttttcgagattaggacctactcagtcttaagggcagtattggttggcgcttatttgcacatattgtatacacgcactcacattaacagaagcacacatatacacttacacctacacacacggataaagaaaaagaaatagaaaatgggcatgttggaactagttggtgagtactgggaacaactaaagataaccgttgtgcctgttgtggccgcggccgaagatgacgataacgagcagcatgaagaaaaggcagcagaaggagaagaaaaagaagaagaaaatggggatgaagatgaggatgaagacgaagacgaagatgatgatgatgatgacgacgaagatgaggaagaagaggaagaagtcactgatcagttggaagatttgagagaacatttcaagaacacggaggagggtaaggcccttgtgcaccactacgaggagtgtgctgagagagtcaagatacagcaacaacaacccggctacgcggatcttgaacacaaggaggactgtgtggaggagtttttccatctacagcactatttggacactgccacggcacctagattatttgacaaattaaagtag

SEQ ID NO: 156 - protein, 147 aa, Saccharomyces cerevisiae
MGMLELVGEYWEQLKITVVPVVAAAEDDDNEQHEEKAAEGEEKEEENGDEDEDEDEDEDDDDDDDEDEEEEEEVTDQLEDLREHFKNTEEGKALVHHYEECAERVKIQQQQPGYADLEHKEDCVEEFFHLQHYLDTATAPRLFDKLK

SEQ ID NO: 157 - DNA, 1325 bp, Saccharomyces cerevisiae
cagagacatgttttaattcaagtgatgaggcggaaacgtgcaagatcctaaatgaaggataaaaagagttcttaaaaagggaagtaaggaataacagagtagaaaaaccgaaaagacaacttaacaaatcggcaacacttttatggggccccgctcgcctgtgtgcaagtagtattcgacctggaacacgcatttaccacgagaagacagcaatagtccgtacaacattaattagtttcgacaattgctcgcctttataagccatgctagtgcccaatcaaacactttacttgccctgaagttccttttttcgctagcctgtaacttaaataagccatctaaccttttttttctaaaaattttctttattaccctgtcggcttattttctattctacacattatttgccacccattgaaattgtagcttgtattaatagggaaaagccggaagtataaccggtggaaagtactattgaagtgagataagaagccatcgtaatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaa

SEQ ID NO: 158 - protein, 274 aa, Saccharomyces cerevisiae
MPSLAELTKSLSIAFENGDYAACEKLLPPIKIELIKNNLLIPDLSIQNDIYLNDLMITKRILEVGALASIQTFNFDSFENYFNQLKPYYFSNNHKLSESDKKSKLISLYLLNLLSQNNTTKFHSELQYLDKHIKNLEDDSLLSYPIKLDRWLMEGSYQKAWDLLQSGSQNISEFDSFTDILKSAIRDEIAKNTELSYDFLPLSNIKALLFFNNEKETEKFALERNWPIVNSKVYFNNQSKEKADYEDEMMHEEDQKTNIIEKAMDYAISIENIV

SEQ ID NO: 159 - DNA, 860 bp, Saccharomyces cerevisiae
actcttttgctagggagtttctgtcgctaagaggtttgtcaatgacaccgaaaagaggataataggtaatactttttgtaactgtaaagaatattaaatcgttttcacggaattggcctcttccctatattctatccgaggttgtgtactgtagcggtttatacttcaacctgtgaaagttatgtaatatgcgaattctgtttctgcttgataatctgaagaatatagtctcgagcacgcgatggagcagaaaggggagaaatgaatactgatgagcttaacgatgaggaggccgtttccgtttctcttgattaccctttcatccaacagtcaatataagtacgccaacttgcgttaaaacggccaatgtgacaccagttcactcggcaagcccttctcaggctctcactagctcgaataacgagaactcttcacgactcatctacttggcattttccgggtgcagttcaacctcactcgcgtgcggcggtgtgaggtgcatgggtgccggtattttttttagttcgctctgcgccttacgcgatcagcttcgagaacatactatattaaatgattatatacgctatttaatgaccttgccctgtgtactatttcttagctcgtttgggcaggcggtgatcgttgtactctgtcgggtcctgtatttcgactatagccggttccggtatttcctccacaaatcttttcttagcgttctcgggcgccgtgtcggcctgggtggaataactgtggtcattaaagcttggcaggttatcactcactttagtgttttcagtggcgctgaactttatatcgggggacacccttgtacttccctcactagtgttattgtcgtttag

SEQ ID NO: 160 - protein, 119 aa, Saccharomyces cerevisiae
MGAGIFFSSLCALRDQLREHTILNDYIRYLMTLPCVLFLSSFGQAVIVVLCRVLYFDYSRFRYFLHKSFLSVLGRRVGLGGITVVIKAWQVITHFSVFSGAELYIGGHPCTSLTSVIVV

SEQ ID NO: 161 - DNA, 893 bp, Saccharomyces cerevisiae
gaagaaaaagaagaaggggatgatgaggaaggagaaatagaacttgaaattattagagtaaaaagaataaagggcaggacgaagataaagaagacgcttacttgcttctcgaaaaacaagaaaattattacccctcagcactccaatagtatgtggttactactaatagtaatcttgatttttgaccgcctactatcgaattaaatataattttataacccagttctatattgctgggtggtattatagcttcatggctagtcaaataagtggagttttttgctctggacgtggcctgtaaagttctcttttgcgacggccccccgctttaaccgaggcgaaatgacaagtgctttctggcaaagaaggaatagccactacaacctgcggtctccacctttctccaccgataatctatttaaacactcacttgccaatcagcaaacgtcaatacatctacatatatacgtatagattttattgcactgtgatcaaaaagaatgtctcaaccggttcaacgcgctgcagcacgctcattccttcaaaaatacatcaataaagaaactttgaaatatattttcacaacacacttctggggtcccgtatcaaatttcggtatcccaattgctgctatatatgatctgaaaaaagaccctacactaatctctggcccaatgacttttgctttagttacctattcaggtgttttcatgaagtatgctctttcagtatcacccaaaaactacttactgtttggatgccaccttattaatgaaactgcgcaattagctcaaggctataggtttctcaaatacacgtatttcacaacagatgaggagaagaaagctctagataaggaatggaaagagaaagaaaaaactggtaaacagtaa

SEQ ID NO: 162 - protein, 130 aa, Saccharomyces cerevisiae
MSQPVQRAAARSFLQKYINKETLKYIFTTHFWGPVSNFGIPIAAIYDLKKDPTLISGPMTFALVTYSGVFMKYALSVSPKNYLLFGCHLINETAQLAQGYRFLKYTYFTTDEEKKALDKEWKEKEKTGKQ

SEQ ID NO: 163 - DNA, 1265 bp, Saccharomyces cerevisiae
tggcttattcactaaggattcttaaggttttcttaatagttttctacgtcggcatgcgattgtttggtttagaagactgctttctaaatatggttgggtgtatttaagctagacccatacacccgctctatgggattatttacttgtttgaattttaagatttgtgataatggaactggacgcaaacatttgatggaaaacgcatgtcatcattaacgaggtaacgtaggtatctgtcctgccttagtattgcacgcagcttcccaggacgcctagctattttttcatctattcccctctgtagtaacgtaagagttttcaagtttttaattcagactttctcttcctttgtttccaatttccttccttactgcttgataccttttcaatcccaaagaaaccgtgttctttatatattgtcgattgaaagttacctacatcaactttccgtgttccattccgactataacaaacaaccaataagctcaactaattaagtaatgtctgctccagaagctcaacaacaaaagagaggtggtttcggtggccgtaacagaggccgtccaaacagaagaggaccaagaaacactgaagaaaagggatgggttccagttaccaaactaggtagattagtcaaggctggtaagattaccaccattgaagaaatcttcttgcactctttgccagtcaaggaattccaaatcattgacactttgttgccaggtttgcaagacgaagtcatgaacatcaagccagttcaaaagcaaaccagagccggtcaaagaaccagatttaaggctgttgtcgttgttggtgactctaacggtcacgttggtttgggtatcaagaccgccaaggaagttgctggtgccatcagagctggtatcattattgccaagttgtccgttatcccaatcagaagaggttactggggtaccaacttgggtcaaccacattctttggccaccaagaccactggtaagtgtggttccgtcactgttagattgatcccagccccaagaggttctggtatcgtcgcttctccagctgtcaaaaagttgttgcaattggctggtgttgaagatgtctacacccaatctaacggtaagactagaactttggaaaacaccttgaaggctgctttcgttgctattggtaacacatacggtttcttgactccaaacttgtgggccgaacaaccattgccagtttctccattggacatctactccgatgaagcttctgctcaaaagaagagattctaa

SEQ ID NO: 164 - protein, 254 aa, Saccharomyces cerevisiae [sequence omitted]

SEQ ID NO: 165 - DNA, 755 bp, Saccharomyces cerevisiae
cgcaatagttatgaacttaaccgagctcaaataatttaaagataaaagataaaagataaaagataaaagacaaaagaaaattcatagcccatgttgaagtatcccagcgggaaatgttgctatccaacagaaagtaccaagccagtttcaaaaaggtacagaattaagtgatgctatccgtcccacaactaattttctccagcggaggaaatatacgcggagggggggaggaaaacctctcagtaagcaatgaagggatagataatgggggcgcgcctgcctagcttaggctaagaaactccttcgaaaacagggggctgcgagcgcagaagcgaacacttgtcatttgtataaaaggactatttataagtttgctttttgtcactctcttggccctaattacccatactattgtaacaattgttgtgtaaactcaattatacaaataaacgaacaatcaacagtaacaaaccgctcaagtgtacaaccaatcagaaaaaatgacgagaacaaacaagtggaccgaacgtgaaggaaaggctgatccaaagtacttttcgcacactggtaactacggtgaatctccaaatcacatcaagaagcaaggttccggcaagggtaattggggtaagccaggcgatgagattgatgacttaattgataatggtgaaatacccccagtgttcaagaaagatagaagaggctcaaatttgcaatcgcatgaacaaaagtttgaaaacgtccaaaaggaatga

SEQ ID NO: 166 - protein, 84 aa, Saccharomyces cerevisiae
MTRTNKWTEREGKADPKYFSHTGNYGESPNHIKKQGSGKGNWGKPGDEIDDLIDNGEIPPVFKKDRRGSNLQSHEQKFENVQKE

SEQ ID NO: 167 - DNA, 2156 bp, Saccharomyces cerevisiae
ttagatcatggctagggggatctggaagtacaatgatgtgctctccccctctcaaacacaacaccaggatgaactaagggctcatctcgaaagtcgaaggtgcctcattcaggttattagtggtgcctgttgtgtcttccatgaacaaggagcacttaattacttgttgttgcatgagatatcatttttttttttccctctttcttggggtcttgacagtcatcaaatcgaagtttttagtttttcttcttcgggaagatcaattttaggtagaaaagtgtagatgaaaaacgaaggatactgctatttactgtaagtactcttcggtccatattggaagaccaaggcataataaggatatattccgaggagataattgggatataatcctccattgcttccgaaatttgtttaaacacttctagttcatttcgggttggttcgatcttcgtttccacttttaacttactcccagttagtataatataagtagttaaggtatggcaagctgcaatccgaccaggaagaagagctctgcttcaagcctatctatgtggagaacgattctcatggcgttaacaacactaccgctaagtgttctttcgcaggagttggttccagctaatagcacaacatcgagcacagctccttccatcacttcgctttccgcagttgagtcatttacgtccagtaccgatgcaacgagcagcgcaagtttatcaacgccgagtatagcttcagtatcctttacttccttcccacaaagttcttcactgcttactctttcgtcaacattatcctcagaactttcctcttcgtccatgcaagtttcgtcgtcttcaacatcgtcgtcttcttcggaggttacgtcatcatcgtcatcatcatcaatatctccttcctcttcatcatcaacaataatatcatcgtcatcatcactgccgacattcactgtggcatcaacatcttcgacagttgcctcctccacactttccactagctcatcgttggttatctctacgtcttcgtcaacgtttacgtttagttcggaaagttcaagctctttgatttcctcttcaatttcaacatccgtttcgacttcttcagtgtacgttccctcctcttcaacttcatctccaccttcgtcctcatccgaattgacatcatcctcgtactcatcatcctcatcctcatccaccctcttttcctactcctcctcattttcatcatcctcatcctcatcatcctcatcatcatcctcatcctcatcatcatcatcatcatcatcatcatatttcaccctctccacatcttcctcttcatccatatactcgtcttcgtcatatccttcattttcatcttcatcttcctcaaaccctacctcatcaatcacttctacatccgcctcatcttctattactcccgcttccgaatattccaatttggcaaaaaccataactagtataatagaaggccagaccatcctctctaactactataccacaataacgtattcaccgacagcatccgcatcttcaggaaaaaattcacatcactcaggcttatcaaaaaagaatcgtaatattatcatcggttgtgtggttggcataggtgcccccctcatcctaattctactaatattgatttacatgttttgtgttcagcctaaaaaaacggatttcattgactctgacggtaaaattgtcacagcttatcgtagtaacattttcaccaaaatatggtatttcttgctgggtaaaaaaattggtgaaacagaaagattcagctcagattcccccatcggcagcaataatattcagaattttggtgatatcgatccagaagatatacttaacaatgacaacccctacacccctaaacacactaatgttgaaggctacgacgacgacgacgacgacgacgctaatgatgaaaacctatcatccaacttccataacagaggcatagatgatcaatactcacctactaaatctgcatcatattcaatgtcgaatagtaatagtcaagattacaacgacgcagatgaagtaatgcacgatgaaaacattcatcgtgtttatgatgacagcgaagctagcatcgacgagaactattacacgaaaccaaacaacggcttaaatatcacgaactattaa

SEQ ID NO: 168 - protein, 551 aa, Saccharomyces cerevisiae
MASCNPTRKKSSASSLSMWRTILMALTTLPLSVLSQELVPANSTTSSTAPSITSLSAVESFTSSTDATSSASLSTPSIASVSFTSFPQSSSLLTLSSTLSSELSSSSMQVSSSSTSSSSSEVTSSSSSSSISPSSSSSTIISSSSSLPTFTVASTSSTVASSTLSTSSSLVISTSSSTFTFSSESSSSLISSSISTSVSTSSVYVPSSSTSSPPSSSSELTSSSYSSSSSSSTLFSYSSSFSSSSSSSSSSSSSSSSSSSSSSSYFTLSTSSSSSIYSSSSYPSFSSSSSSNPTSSITSTSASSSITPASEYSNLAKTITSIIEGQTILSNYYTTITYSPTASASSGKNSHHSGLSKKNRNIIIGCVVGIGAPLILILLILIYMFCVQPKKTDFIDSDGKIVTAYRSNIFTKIWYFLLGKKIGETERFSSDSPIGSNNIQNFGDIDPEDILNNDNPYTPKHTNVEGYDDDDDDDANDENLSSNFHNRGIDDQYSPTKSASYSMSNSNSQDYNDADEVMHDENIHRVYDDSEASIDENYYTKPNNGLNITNY

SEQ ID NO: 169 - DNA, 1244 bp, Saccharomyces cerevisiae
tataaaaaaaattcttgtagacaataaaataagaaatgcccattttgtaacttagcgaaagatgcccagtacatcccttttacacccgtgcattaaaggtgtttgggtttaataggagctttatcatatctctttgattttttttctgctgtcctcggcttgagggactcacagagatctggaaattttcagattgtcagtgcttaggatgggttgtcagtagacggtggccgccgtggatgggaaatctcatacgtttacacacatagtgtttggaaattaatagtagcaatagctatctggctactgttttaaagtattagcccgttctcagtgcttcttttttaaggaataacaacggcaagaccaaagatatatcaaatatggctaagcaatctctaggtatgtttggaggatacgaataacgatagaaaacatgagtgaatttccgtccacgaaaaaatgttaacataaaatgcaagagaacaattaatcgaataatgttaaattattgtaaaacaatgtgtatgatgaggaggaatgtacctaagccaaaaaaaaaaaaaaaaaaaaaaaaaaaaaaagaaacagcttttgcatattcaatccaggcatagggcgactatttagcactcaacgatttttaagcttgtgtattgctgacataaattccggctttagaatccaatattgaaaaacgtgagtacgcagaggagatagaagaaaagtaggaagttaccgtttatattgatttgtgaaatgcatactccgttggatgtggggcaacatagatttaagtgtggatgaaaattatgtgctcattgtgaaaaaaaagttttgcttttactaacaaatttttttattatttgttttcaatagacgtttcctctgacagaagaaaggccagaaaggcttatttcactgctccatcctctgaacgtcgtgttttgttatctgctccattatccaaggaattgagagctcaatatggtatcaaggctttgccaatcagaagagacgatgaagtcttggttgttcgtggttccaagaagggtcaagaaggtaagatttcatctgtttacagattgaagtttgctgttcaagttgacaaggtcaccaaggaaaaggtcaacggtgcttccgttccaattaacttgcacccatccaagcttgttatcactaagttacacttggacaaggacagaaaggctttgatccaaagaaagggtggtaaattggaataa

SEQ ID NO: 170 - protein, 129 aa, Saccharomyces cerevisiae
MLNYCKTMYVSSDRRKARKAYFTAPSSERRVLLSAPLSKELRAQYGIKALPIRRDDEVLVVRGSKKGQEGKISSVYRLKFAVQVDKVTKEKVNGASVPINLHPSKLVITKLHLDKDRKALIQRKGGKLE

SEQ ID NO: 171 - DNA, 836 bp, Saccharomyces cerevisiae
ttcgaattattttgttgaaaacagggctcgaaagtgatctcttgcttagaaatattgcgttgccgctggtgtccatatcttggttgcttgtactgcgaccgctactactgttatgttgattttccgcattttccccaccgactaaaacatccccttttgaagaaaccaataagttgtcccaatagcattcgaaaatcttacgcttttccttaactagacttgccaaactactgctattcttcttatatcggccaacttgcaaaaactccaatttgaatcttcctaccaatctcagcgaaattttcttcactacgatctcatttttcactgaaatcactaagtttcctgataaaggtatagacgacagttccaacggtgacccttggatcaaaattatgtccttgtacggggagtttattctaatatcaaaataacttattctctctctttccttctgctctgaatgcccaccgctgctagatagcgaactaagtgaaaacatggtcttgcttcaccctattctcgccgagagctgtacaagatattttttacttttgccatcttatactcatcctaatcatctgtttcattttccttctatttcttttttttttttttttttttttttttttttcagttttcgaagaaactgcctttttagaattgtaaaagacgaagtgaagtattcaggagtatattattacatacatacaaagcaagacaaagaaacatttttagatctaacattttacttcaattgtttttgtattccttataataagaaagacctgctgtttaatgtgggagtaatccgtcccctactcgatcttcaataa

SEQ ID NO: 172 - protein, 111 aa, Saccharomyces cerevisiae
MVLLHPILAESCTRYFLLLPSYTHPNHLFHFPSISFFFFFFFFFFSFRRNCLFRIVKDEVKYSGVYYYIHTKQDKETFLDLTFYFNCFCIPYNKKDLLFNVGVIRPLLDLQ

SEQ ID NO: 173 - DNA, 3968 bp, Saccharomyces cerevisiae
aagaaacatttttagatctaacattttacttcaattgtttttgtattccttataataagaaagacctgctgtttaatgtgggagtaatccgtcccctactcgatcttcaataaattgtcatcttgtatctaaaggagcgctccagtactccaattaagcaccacctagtgcgtctagtgtcgatttttttttcacgcatacgtttgtatgtttcttaaatttcccatgattttttgttgccaatgtcatatctacaaactctatacgaaagtaaacgcacttcatcttttttgccctaaaacggcaatatttagacatatcataaggggcccaagggagaatcgttaattttaaacttttctttgctcttgaatgaaaaagtaaataaataaaactaaatcaaaaaaaagaacgccacgtttgaattttaaagcaaaaattttgttgatttagtaatgatataaataaaaccaagtcgttggtaagaatttggttaggttatgaatagtaatgaactggatctaagaaataaatatttttatgagatattcggtaagaaaagaaaatcagatacttcaacccctactcagttgttctccggctccaaagttcagacaaacatcaatgaaatttctatcactaacgatgaggatgaagatagtactgaagatgaaaataaggcttcattgaaggattatacactagggcacgacaccggtgcacggtataggatagcaccggactgttcttcccaccaattaaaggcatctcctgtcctacatatttcaacaaaccttaattcaagtccacaatccttcacaggcgatcagatttcacctactaataaaaaaatttcaataaatgattcgaccagacaagataaaggtaacagttgcactaccacttcatcaccttctcaaaaaagatcgaatgttttgcttcctcacgtaagaaaacattcatctccttcactattatcattttccaaaaacagtggcagtcatatgggggatccaaaccagctatctacgcctccaactcccaaaagtgcaggtcacacgatggagttacacagttcattcaatggaaaacatagttcttctagcacctcttctttatttgcattagagtcactgaaaacccaaaatagacgctcatcaaactcttccaatcattctagtcaatatcgacgccatactaatcaacaccaacgtcatcattcaaggtccaaatcaagtcctgtctctctgacggaaatatccatgatcaaaggcacgcctttggtttatcctgcacttttatcactaatagcaattaaattcaaacagaccatcaaattgagcacgcataaaaagatggggttactttacagagattcctttacaggaaaacaagcaattgatactttatgcttgatcataggaagcttagatcgtaatttgggcatgttgatcggaaaatcgctggaagctcaaaaattgttccatgacgtactttatgaccatggcgtaagagattctgtactggagatttacgagttatcttcagaatcaatttttatggcacatcagtcgcagagttctacttcaattgccaacacattttcttcatcatcttcttcagttaattcgctccgtactaaaactgaaatatatggtgtttttgtcccattgacacattgttattcctctacatgctctctggaaaaactttgctactctatttcttgccccaatcgtttgcaacaacaggctaatttacatttaaaattaggtggtggtcttaagagaaatatttcgttagcactcgataaggaggatgatgaacgaatttcctggacaaattctgtaccaaagagcgtatgggaatcattatccaaacaacaaatcaaaaggcaggaggcaatatatgagttgtttactacagaaaagaagtttgtaaaatctttggaaatcatccgagatactttcatgaagaaattattagaaacgaatattattccatctgatgtaaggataaattttgtaaagcacgttttcgcacatatcaatgaaatatattctgtcaatagagaatttttgaaggctttagcacaaaggcaatcattaagcccaatttgtcctggaattgcagatatatttttgcagtatcttcctttctttgatccttttctgtcatacatagcatcaagaccatacgcaaagtatctaattgaaacccaaagatcagttaatcccaattttgctcgttttgacgatgaagtgtctaattcttccctgaggcatgggatcgattcattcctatctcagggtgtttcaagacctggtagatattcactgttggtaagagaaataatacacttctcggacccagtaacagacaaagatgatctacaaatgctaatgaaagtccaagatcttttaaaggatctaatgaaaaggattgatagagcaagcggtgcagcacaagatcgttatgacgttaaagtgttaaagcagaaaattctattcaaaaatgaatacgttaatctgggtttgaataacgaaaaaaggaaaatcaagcatgaaggtttactctcaaggaaggacgtgaacaaaacagatgcgtccttttcaggagacattcaattttacctactcgacaatatgctattattcttgaaatcaaaagctgtaaacaagtggcaccaacacactgtatttcagagaccaattccactccctttactgtttatttgtccggctgaggatatgccacccataaaaagatatgtgacagaaaacccaaattgctcagcgggtgtgctcttaccccaatatcaaacgagcaatcccaagaatgctattgtattcgcctattacggtacgaaacaacaatatcaagttactttgtacgcgccgcagccggccggattacagacattaatagaaaaggtgaaacaagagcaaaaaaggctccttgatgaaactaaacatattacttttaagcaaatggtaggtcaattctttcactcatacataaatactaatcgcgtcaacgatgtcctaatctgtcatgctggtaaaattttattggttgcaacaaatatgggactctttgttcttaattatgctacatcgatcaatcaaaaaccagtgcaccttctgcacaaaatatcaatttcacagatctctgtattggaagaatataaagttatgattcttctaattgacaaaaaactgtacggctgtcctttagacgtaatcgacgatgcagaaaatgcagattttcttttcagaaaaaattctaaagtgttatttaaatatgttgcaatgttcaaagacggtttctgtaatggtaaaagaatcattatgattgcacatcattttttgcacgccgcacaattattgattgttaatcctttgatatttgattttaatagcggtaattttaaaaaaaacctaaaggcaggcttggtagattttagcgttgattctgaacctctgtccttttcttttttggagaataagatctgcattggttgtaaaaaaaatatcaaaatattaaacgtaccggaagtgtgtgataaaaatggatttaaaatgagggagcttttaaatctacatgataacaaagttttagcgaacatgtataaagagacgttcaaagtagtttccatgtttccgataaaaaattcaacttttgcatgttttccagaactctgcttttttctcaataagcaagggaagagggaggagacaaagggatgttttcattgggagggggaaccagaacagttcgcgtgttcctacccttatattgtggcaattaatagtaactttattgaaattagacatatagaaaatggagaacttgtccgctgtgtacttggaaacaagatacgtatgttaaaatcatatgccaagaagatcttatattgttatgaggatcctcaaggatttgaaattatcgaactgttaaatttttga

SEQ ID NO: 174 - protein, 1155 aa, Saccharomyces cerevisiae
MNSNELDLRNKYFYEIFGKKRKSDTSTPTQLFSGSKVQTNINEISITNDEDEDSTEDENKASLKDYTLGHDTGARYRIAPDCSSHQLKASPVLHISTNLNSSPQSFTGDQISPTNKKISINDSTRQDKGNSCTTTSSPSQKRSNVLLPHVRKHSSPSLLSFSKNSGSHMGDPNQLSTPPTPKSAGHTMELHSSFNGKHSSSSTSSLFALESLKTQNRRSSNSSNHSSQYRRHTNQHQRHHSRSKSSPVSLTEISMIKGTPLVYPALLSLIAIKFKQTIKLSTHKKMGLLYRDSFTGKQAIDTLCLIIGSLDRNLGMLIGKSLEAQKLFHDVLYDHGVRDSVLEIYELSSESIFMAHQSQSSTSIANTFSSSSSSVNSLRTKTEIYGVFVPLTHCYSSTCSLEKLCYSISCPNRLQQQANLHLKLGGGLKRNISLALDKEDDERISWTNSVPKSVWESLSKQQIKRQEAIYELFTTEKKFVKSLEIIRDTFMKKLLETNIIPSDVRINFVKHVFAHINEIYSVNREFLKALAQRQSLSPICPGIADIFLQYLPFFDPFLSYIASRPYAKYLIETQRSVNPNFARFDDEVSNSSLRHGIDSFLSQGVSRPGRYSLLVREIIHFSDPVTDKDDLQMLMKVQDLLKDLMKRIDRASGAAQDRYDVKVLKQKILFKNEYVNLGLNNEKRKIKHEGLLSRKDVNKTDASFSGDIQFYLLDNMLLFLKSKAVNKWHQHTVFQRPIPLPLLFICPAEDMPPIKRYVTENPNCSAGVLLPQYQTSNPKNAIVFAYYGTKQQYQVTLYAPQPAGLQTLIEKVKQEQKRLLDETKHITFKQMVGQFFHSYINTNRVNDVLICHAGKILLVATNMGLFVLNYATSINQKPVHLLHKISISQISVLEEYKVMILLIDKKLYGCPLDVIDDAENADFLFRKNSKVLFKYVAMFKDGFCNGKRIIMIAHHFLHAAQLLIVNPLIFDFNSGNFKKNLKAGLVDFSVDSEPLSFSFLENKICIGCKKNIKILNVPEVCDKNGFKMRELLNLHDNKVLANMYKETFKVVSMFPIKNSTFACFPELCFFLNKQGKREETKGCFHWEGEPEQFACSYPYIVAINSNFIEIRHIENGELVRCVLGNKIRMLKSYAKKILYCYEDPQGFEIIELLNF

SEQ ID NO: 175 - DNA, 1520 bp, Saccharomyces cerevisiae
gttgaatatttaccaattgggaaaaagaactcgtatttcattcccctttttggaaaggggtggggagagactgttgttcagccacgtcaattattattttttctttggccctgcgcttgtcttataaaattccgcagccgcctcttatttttttttttttcgatttttggcccacaggtcatattgcaaaaaccgaatggccgcgcccccctcacgcacgggacggaagaagggcggcgtcccctgtttttctgctttggctcatctctttggctccgacggacgaaagacgggattccccctcccgtgtctttttataaataacaagtgctcattctgcatccttccttgtttcccgtcgtttgggtacaatgcgttgattatcccaacccaagaaagaaaatttgtctcacatctgcatctgcacatttatttacctatacttttccattgttagcagtattgcaaagtgaagaatatatcagcatcaagtatatagtatgcacagaacttactctttaagaaattccagggcacctaccgcctctcaattacagaacccaccgccaccaccatctacaaccaaaggtagattctttgggaagggtggtctagcttacagctttaggagaagtgctgctggagcttttggcccagaattatccagaaagttgtctcaattggttaagattgaaaagaatgttttgaggtccatggaattgacagccaacgaaagacgtgacgctgctaagcaattgtctatttgggggttggaaaacgatgacgatgtttccgacatcactgataaattaggtgtcttgatctatgaagttagtgaattagacgaccaatttatcgatcgttatgaccaatacagattgactctaaagtccatcagagatatcgaaggttctgttcaaccatctagagaccgtaaggacaagatcaccgacaaaatcgcctacttgaaatacaaagatcctcaatcacctaagattgaggtcttggaacaagaattggtgcgtgctgaggctgaatctttggtcgctgaagctcaattatctaatatcacaaggtcaaagttgagagctgctttcaactaccaatttgactccatcatcgaacattcagagaaaattgctttaatcgctggttacggtaaggctctcttggaactattggacgactctcctgtcactccaggtgaaaccaggcctgcttacgatgggtatgaagcctctaaacaaatcattattgatgctgaaagcgcactgaatgaatggacactagactctgcccaagtcaagcctactttaagtttcaagcaggattacgaagacttcgaacctgaagaaggcgaagaagaggaagaggaagacggtcaaggcaggtggtccgaagacgaacaagaagatggacaaattgaagaacctgaacaagaagaagaaggtgctgttgaagaacatgaacaagtcggacaccagcaaagtgagtctcttccccaacaaacaacagcttaa

SEQ ID NO: 176 - protein, 339 aa, Saccharomyces cerevisiae
MHRTYSLRNSRAPTASQLQNPPPPPSTTKGRFFGKGGLAYSFRRSAAGAFGPELSRKLSQLVKIEKNVLRSMELTANERRDAAKQLSIWGLENDDDVSDITDKLGVLIYEVSELDDQFIDRYDQYRLTLKSIRDIEGSVQPSRDRKDKITDKIAYLKYKDPQSPKIEVLEQELVRAEAESLVAEAQLSNITRSKLRAAFNYQFDSIIEHSEKIALIAGYGKALLELLDDSPVTPGETRPAYDGYEASKQIIIDAESALNEWTLDSAQVKPTLSFKQDYEDFEPEEGEEEEEEDGQGRWSEDEQEDGQIEEPEQEEEGAVEEHEQVGHQQSESLPQQTTA

SEQ ID NO: 177 - DNA, 1364 bp, Saccharomyces cerevisiae
catacatgtatcagacgtatagctcctacgattctcaagaatccagaagtttggcatattatgtataaaggcgatgattatgtatattttatgttgtctccagtaagtggcagcataacccggccagtctgcgctgcatgctgtgaagcagtaatatgcgatatataccacatatattccgcttccgttcaggatttcgaaaagagaaacttcagtgaatgactatgactacatagttggagtcttagaccattgcaaatgagttattcaagtatgagagatcaacactgatgagaataaactcgtcttcatgatgatacgggtaacgcgaatgtatcgcatcaataaatttcagggaaagggagtttgacgatctcatggatgcaacggttgaggtatataatattaagcagaaagaagaggaaaaaaaataaatcggtaaaccaaccatcaacggtacgaaacttacattcaaaatcaataatttactttagaaaagaatgtctaattctgccaaacttatcgatgtcatcaccaaggtggcgttgcccattggtataattgctagcgggattcagtactccatgtatgatgtgaagggtggttctcgtggtgttattttcgacagaatcaatggtgtaaagcaacaggttgtgggtgaaggcactcatttcttggtgccttggctacagaaggcgatcatatacgatgtgaggacgaaaccaaagagcattgctaccaatactggtacgaaggatttgcaaatggtgtcattgaccttgagagtcttacatagaccagaggtcttacagctacccgcaatataccaaaatttgggtctcgattacgacgaaagagtgttaccatctatcggcaatgaggttttaaagtctatagtagctcaatttgatgctgctgagttaattactcagagagaaattatttctcaaaaaatcagaaaagagctttctacgagggccaacgaattcggtattaagttggaagatgtctctatcactcatatgacgtttggtcccgaattcacgaaagcagttgagcagaagcagattgcacagcaagatgccgaaagagccaaattccttgtcgaaaaggcagagcaagagagacaagcttctgttatcagagctgaaggtgaagcagaaagtgctgaattcatttcaaaagccttagctaaagttggtgatggtctgttattgattagaagattagaagcttctaaggacatcgctcaaacattagcaaactcatctaacgttgtctatttaccaagtcaacattctggtggtggtaacagcgagtcttcgggatcaccaaattccttgcttttgaacattggccgttaa

SEQ ID NO: 178 - protein, 287 aa, Saccharomyces cerevisiae
MSNSAKLIDVITKVALPIGIIASGIQYSMYDVKGGSRGVIFDRINGVKQQVVGEGTHFLVPWLQKAIIYDVRTKPKSIATNTGTKDLQMVSLTLRVLHRPEVLQLPAIYQNLGLDYDERVLPSIGNEVLKSIVAQFDAAELITQREIISQKIRKELSTRANEFGIKLEDVSITHMTFGPEFTKAVEQKQIAQQDAERAKFLVEKAEQERQASVIRAEGEAESAEFISKALAKVGDGLLLIRRLEASKDIAQTLANSSNVVYLPSQHSGGGNSESSGSPNSLLLNIGR

SEQ ID NO: 179 - DNA, 1277 bp, Saccharomyces cerevisiae
ttctgaactgaatctgaaattgttaaacctgtttccctcaaagcctgcaaacaaagacgatagttcccctattaacacgttgcgtagttttatcgctgattactccttcgacacccaggtgaaccctccaggaagaagggtggtgttctacgatggtaagattttgccattgcccaaagccgataagcctatcccacttcatgaatatataacactcgcagagctcgatgttggagacagtgagtgagcagtgaattgctcatgttttctctgcatcctcatttaatgacaattagccatgtaataacatcttgaggcagttaaatattcgttaccctgcaggtggcaaaaaatttatagaataaaagcataaaaagatggatatctatgtaataaggaaacattggcagagcgaagagaacagactgctttctataaaaagttttcgatcagtctctattttaataattgattattggatatagttagtagtgttaaacatgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataa

SEQ ID NO: 180 - protein, 258 aa, Saccharomyces cerevisiae
MGSRRYDSRTTIFSPEGRLYQVEYALESISHAGTAIGIMASDGIVLAAERKVTSTLLEQDTSTEKLYKLNDKIAVAVAGLTADAEILINTARIHAQNYLKTYNEDIPVEILVRRLSDIKQGYTQHGGLRPFGVSFIYAGYDDRYGYQLYTSNPSGNYTGWKAISVGANTSAAQTLLQMDYKDDMKVDDAIELALKTLSKTTDSSALTYDRLEFATIRKGANDGEVYQKIFKPQEIKDILVKTGITKKDEDEEADEDMK

SEQ ID NO: 181 - DNA, 2024 bp, Saccharomyces cerevisiae
gtgttctcatccgaccctctgattcatttggtggccattacattttccctcaatgacacattcccctatttcataactgattaaaatggtaatggcacgtgatagtagtggctcacaaaacaaaattttctttctcagcgctgacaaagcttcatttgcattctaaccttatcacaacaacttcaacttcacccaagtaaggataatcagctctgtcgtgactgataaatgctatatccggcatatgcagtccacacggcattaccgtttcactaatttattgccatcttcctccacagttttgcaccgaaaggaaaaaaagaaaccaacaccgaaaatttttttctcctaaaggttaaagtaaacgcaaggcacttcaccaggcttgtatatataaatgtcgtgatgcttctatgccaaagtaaaaggcaacacttgaagatttcgttgtaggccacttgctcaaaggacatctagataaatacgacgtaagaataaaaatgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgacccattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctgccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataa

SEQ ID NO: 182 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 183 - DNA, 1499 bp, Saccharomyces cerevisiae
acagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggttagagttgctattaacggtttcggtagaatcggtagattggtcatgagaattgctttgtctagaccaaacgtcgaagttgttgctttgaacgacccattcatcaccaacgactacgctgcttacatgttcaagtacgactccactcacggtagatacgctggtgaagtttcccacgatgacaagcacatcattgtcgatggtaagaagattgctacttaccaagaaagagacccagctaacttgccatggggttcttccaacgttgacatcgccattgactccactggtgttttcaaggaattagacactgctcaaaagcacattgacgctggtgccaagaaggttgttatcactgctccatcttccaccgccccaatgttcgtcatgggtgttaacgaagaaaaatacacttctgacttgaagattgtttccaacgcttcttgtaccaccaactgtttggctccattggccaaggttatcaacgatgctttcggtattgaagaaggtttgatgaccactgtccactctttgactgctactcaaaagactgttgacggtccatcccacaaggactggagaggtggtagaaccgcttccggtaacatcatcccatcctccaccggtgctgctaaggctgtcggtaaggtcttgccagaattgcaaggtaagttgaccggtatggctttcagagtcccaaccgtcgatgtctccgttgttgacttgactgtcaagttgaacaaggaaaccacctacgatgaaatcaagaaggttgttaaggctgccgctgaaggtaagttgaagggtgttttgggttacaccgaagacgctgttgtctcctctgacttcttgggtgactctcactcttccatcttcgatgcttccgctggtatccaattgtctccaaagttcgtcaagttggtctcctggtacgacaacgaatacggttactctaccagagttgtcgacttggttgaacacgttgccaaggcttaa

SEQ ID NO: 184 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 185 - DNA, 2144 bp, Saccharomyces cerevisiae
tccagtatgccacacattatgccttgcacacctaaagcacatattttcgttatttttcaccacaataggtggatctcgaaaaggatggaaaatcaggaaaaagaaatgttgagaaaaaaataaaccgattcccgtttagttttctcctatttccgtgtatatgcgtggttattcgttttcgaatccttttatgaatgtccgaggaggtggtacaatccgaaatagactaaagaaaagcgaaagccgtgagtttgtttgatgatagatgactcgcagctttgtcatcaacgggccaccctattcgaagaagggaatggaaaacggactggcgtagtcaataagcgtcttcatatcttagcattgttgagagatacatagtgtactccatatcgttctttttttttgtatatatcaagccacatatcctgtttctttaatcttttatacgccgtaagaatcgggtactgacataagtgtaagtagccgtacagagaacaaatatgactaaatcggttggtgatgaagagtcacagtacattgaggaccctagttttgcagcagcagctgcatttactggcggcagggacggggtttcgtacagtaatcagcgatttgctgagggttccggccattcttctgacttagcaaagtcattagaagactatcggcctcctgatgaaaagccgtcctcattgtcatctgtgggggaaggtggcgctaatgaggaagagaagggcggtaacgacggcggtcccttggcaagaattcaaacagggcttttttctccaagactgcgaaatcataggaaaaagattctctcgaagtttgttttgaacaacttcttcattgcttgtgtgtgtgtatcgctcatatcgatttactggggtgcctgttacggaacagatcgttactttttcaaagtgaaaaatattgttgtattgcaggatgcgccatctaatacttcagttcaatctatttccgcgatcataccctcattgttagcgtctgtccccgggacatggcatatatacaacgcaacatcatttcataggaaatttggtacgacgaactccaccgaaattgacagaaagatagtcgatttaatttacgatgagagatactggctggcgttaaacgttaaacctaatgctacagacactttgtataattctttgattagccaagacgcaaactcggagttcaattcatcaattttttttgaatccgtgtttgaaagtggtcgtgacccatcgagtgttaaatcgaccattctaccactcatgcaacaattggaggtccgccttcagaaatattacgtcaaggaatatcttccctcattgatgagcaacatcacttctaatgacagagatcttaatataaacatggagaactgggcgattgcaggacagttgttgttcacctacaacgattatcgtccctttgctgatcgtattctaatggcccctctgcaggtcggtctgatttattgtattttgttaaccgttttacaactgtcattatatggtaagttgcacggagaaatggccagagttctgaagccaaagcatattttaatctacaggcttctaatttcctgggcaacttattttcttctttccattggattctgtaccgtatctgcaatttttaggatcgatttcacccccgcctttggcagaggaggattcgtagtatattggatgtctacgtggttggtaatgatggctgttggtggtgccaatgaaaacgttctcagcttagttatagcttactgccctccatacctgagtatttggttgatgacgtggatcatattaaatatttctgcttcattctacccaatggttttgaacaacgaattttacaggtacggctacataatgccaatccataatgccgtggatatctataaagtgatttttttgaatttaaccaaaagaaaaatgggaagaaattacggtattctcgtggcatgggttgccctcaatacatccttgatgccattttgtatgaagtttgcaggtaaaaaaatgcaaaaaaatgctatgcaagcagcagaagccgctgtcgcagcagctacccagcgtgctagccgcccggcagaggccaatactgataaaaataacaacccgcccggaaattaa

SEQ ID NO: 186 - protein, 547 aa, Saccharomyces cerevisiae
MTKSVGDEESQYIEDPSFAAAAAFTGGRDGVSYSNQRFAEGSGHSSDLAKSLEDYRPPDEKPSSLSSVGEGGANEEEKGGNDGGPLARIQTGLFSPRLRNHRKKILSKFVLNNFFIACVCVSLISIYWGACYGTDRYFFKVKNIVVLQDAPSNTSVQSISAIIPSLLASVPGTWHIYNATSFHRKFGTTNSTEIDRKIVDLIYDERYWLALNVKPNATDTLYNSLISQDANSEFNSSIFFESVFESGRDPSSVKSTILPLMQQLEVRLQKYYVKEYLPSLMSNITSNDRDLNINMENWAIAGQLLFTYNDYRPFADRILMAPLQVGLIYCILLTVLQLSLYGKLHGEMARVLKPKHILIYRLLISWATYFLLSIGFCTVSAIFRIDFTPAFGRGGFVVYWMSTWLVMMAVGGANENVLSLVIAYCPPYLSIWLMTWIILNISASFYPMVLNNEFYRYGYIMPIHNAVDIYKVIFLNLTKRKMGRNYGILVAWVALNTSLMPFCMKFAGKKMQKNAMQAAEAAVAAATQRASRPAEANTDKNNNPPGN

SEQ ID NO: 187 - DNA, 815 bp, Saccharomyces cerevisiae
aacatccagacttttacgggtggcaacggaaccaacgtatttagagattgttttttggtcaagcgaggaacccctgttggcaaagttgccaggtatatcatgggtggcgaggtcaccattgcaagcattgaaaccgttggcggcgtgagagtcagtgaagaaagtcttgttgagcccggtaagaatgacatactcggcttcaagatcgctccaagatcagcataacttgagtgccagtgaatattaagtaatcatcaaagtatatgtgtaattgtttatactcttagtaaaggatgctccctacaaggtggctcttttcttactaagcgcgttcagtttccagccagccgaaagagggatatcagtatataagaaagccattcgggggatgaaaagctgacaagagaataacgaggaccagtttttatttgttgtctagcaagaattatacacgcacacatacacgagagtctacgatatctttaaataacacatcaataatggtcactcaattaaaatccgcttctgaatacgacagtgctttagcatctggcgacaagttagtcgttgttgacttttttgccacatggtgtgggccatgtaaaatgattgcaccaatgattgaaaagtttgcagaacaatattctgacgctgctttttacaagttggatgttgatgaagtctcagatgttgctcaaaaagctgaagtttcttccatgcctaccctaatcttctacaagggcggtaaggaggttaccagagtcgtcggtgccaacccagctgctatcaagcaagctattgcttccaacgtatag

SEQ ID NO: 188 - protein, 104 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 189 - DNA, 941 bp, Saccharomyces cerevisiae
cctccaccaaagcaaaatgaaaacaaagccatactgggaaaaatctgaaaaaaaaaatggtaggagtaaaagaaaagaaaaaataaaggttaccctgcagtttggatagtcgggtaacatttggcccttttcctccttgattggatattattaccccgattacccctcatcttgggagtgccccgcttttatttctcccgccaatcggctattaacggctttacgtcattccgtgggcgggtcaagcgagccgctccctggtttggtcacgcaaaaccgaaaggctcaaacaaaactaaggccatcatatatatatatgcggctgcgtgcgtgtattctcccggataatatggtgcgttgcaattggagtattggagaaaattttcttttccctttcattacggcggaaatacttcatataaaaaaaaagaatacaatcagtctttaagactatacgcataagcattcaagacacatagaaacacaaacctatatttttaatgtcagcatcagcttttaattttgcctttagaagattttggaatagtgaaacaggccctaaaacagtacacttctgggccccaactttgaagtgggggctggtcttcgcagggctaaatgatattaagaggcctgttgagaaggtatcaggagcacaaaatttatctttattagcgacggcactgatttggacgcgttggtcgtttgtcatcaagcccaagaactatctgttagcttccgtcaattttttcctgggttgcactgcaggctaccatctaacaagaattgctaactttaggatacggaacggtgattcttttaaacaggttattcactacataataaaaggggagactcctgcagccgtcgcagcaaagcaaactgcatccacatcgatgaacaaaggtgtgatcggtactaatccgccaataacgcactga

SEQ ID NO: 190 - protein, 146 aa, Saccharomyces cerevisiae
MSASAFNFAFRRFWNSETGPKTVHFWAPTLKWGLVFAGLNDIKRPVEKVSGAQNLSLLATALIWTRWSFVIKPKNYLLASVNFFLGCTAGYHLTRIANFRIRNGDSFKQVIHYIIKGETPAAVAAKQTASTSMNKGVIGTNPPITH

SEQ ID NO: 191 - DNA, 2846 bp, Saccharomyces cerevisiae
tcttgtgtacgtacgatgtttctcccgctgatccgattactagccgaagacgtaaaattggcgcttgattcaatttatgcccttcccgggaatagttgaccaaagggcaaaaaaattcagtcggagattccctattgggcggaatttagtagatctctttccgtgcataacgcctgcccgttagtcgttatttcacgttaacattttcttggccactgcgctatataaataaatacatatatatatgtcaagcacaataaagaaacttcccttaaatattgaataagtaaataatagttgaaaagtgccttttgttcgaaggattagagtgttcttaattttagttcgttcaacggtctcaaaaaaagtgtgaacaagtaaagcatagcacacatcccaaattacaaggcaccctgattaaaaatccaaaaataaaccataagttttattttactaaaaacattatacgtgaaagacaaaccgcatcagaagtttcgaggatgaatattgcagaagaaccatcagatgaagtaatatctagtggccccgaggatacagatatctgcagccagcagacatcagcgagcgcagaagctggagaccaatcaataaaaattgaaaggaaaacttccactggtcttcaactggaacaattggccaacacaaatttattaaccataagaataaaatggcagttacaagaagaagaagatgatcactgcaactctagaataaccgatcaaataatggacacaatacagcactacaaaggtatctccgttaacaactctgatacagaaacatatgaatttcttccggatacaaggaggttacaggttctcgaacaaaataaagacatctatctttacgagcatggaagtcaagagtatgagaaatcttacaaagataacgaagaggaagatgattggagatacgataccgttttgcaagcacaattcaagtaccccaagtcattagaaaatgcatgtacagatatctcggaattactcaagagcgaacctattggtcagcatattgataaatggtctatcggtgtgaacaagcatgcactaacctatcctggaaatatttttgtcgggggaatagcaaagagcctttctattggtgaactaagtttcttattttcaaaatatggaccaattttatcaatgaaattgatatatgataaaacgaaaggcgaacctaacggatacgggttcatctcctaccccttgggttctcaagcttcactttgcatcaaggaacttaatggaaggacggtaaatggctccacactatttatcaactatcacgttgagcgaaaggagagagaaagaatccattgggaccatgtcaaagaaaacaacaatgatgataatttcaggtgtctctttataggcaacttgccttatcacaatcctgaaaaagtagagactttgattacacctaaagaagtcatagaagtaatcaagaaggagttatcaaaaaagtttccggactttgatatcatttcatattactttccgaagagaagtaatacaagaagcagtagttcagtaagtttcaatgaggaggggtcagtagaatcaaacaaatcttccaataatactaatggaaatgcccaagatgaagatatgttgaagggttatggtttcatcaagcttatcaaccatgaacaagcactagcagccatcgagaccttcaatgggttcatgtggcatggaaacaggctcgttgttaataaggcggttcaacataaagtttacaacaaccacaatagccatgacaggcacccttccatcagtaaccacaatgatatggaggttttggaatttgcaaataacccaatgtatgattacaataattatacatatgatagatattacttcaacaataataaaaacgggaacagcaacgatacctccaatgtacggtattttgattctgtaagatcaacccctgtggcagagaaaatggatctgttctatcctcaaagggaatctttcagtgaaggtcgtggtcaacgtgtgcctagattcatgggcaacaagtttgacatgtaccagtacccatcaacttcttacagcttacctataccaatgagtaatcagcaagaatcaaacctatatgtcaagcacatccctctttcttggacagatgaagatttatatgatttctacaaatctttcggtgaaataatcagcgttaaggtcattactgttgggggtagtaagaacaagtatcgtcaacaatcgaatgatagctcatcagataatgatctgccagtgggatcatcaagaggttatggttttgtttcttttgaaagcccattagatgctgctaaggcaattttgaatacagacgggtatcaagtgagcaaagatcaagtgttatctgtttctttcgctcagaaacgtggtaatttatcttcaagtgatgatgatgatcaatcccaaactgataactcatcaaagttccaaaattttcagccacataatgattatcataaggcttatccaacaaagtataataagaaatttatcaatgccttgatgactcagaaccaatcgcaacagcaagtctcgagggaaaattatttcataccactgcagtaccctaataccaacacaaagcccgtgaacagttacaacttaataagtgcaaaccaaaataacgctaactggatgatgccaatgttcccatcatttgggtttattccacaggtgccgccagtgccctatataatacctccgcagaatcctgcagcaaatcatattcctataatggcaaacggtagtaatgaagaggaagaattttctagtggtgattattctatggactactag

SEQ ID NO: 192 - protein, 781 aa, Saccharomyces cerevisiae
MNIAEEPSDEVISSGPEDTDICSQQTSASAEAGDQSIKIERKTSTGLQLEQLANTNLLTIRIKWQLQEEEDDHCNSRITDQIMDTIQHYKGISVNNSDTETYEFLPDTRRLQVLEQNKDIYLYEHGSQEYEKSYKDNEEEDDWRYDTVLQAQFKYPKSLENACTDISELLKSEPIGQHIDKWSIGVNKHALTYPGNIFVGGIAKSLSIGELSFLFSKYGPILSMKLIYDKTKGEPNGYGFISYPLGSQASLCIKELNGRTVNGSTLFINYHVERKERERIHWDHVKENNNDDNFRCLFIGNLPYHNPEKVETLITPKEVIEVIKKELSKKFPDFDIISYYFPKRSNTRSSSSVSFNEEGSVESNKSSNNTNGNAQDEDMLKGYGFIKLINHEQALAAIETFNGFMWHGNRLVVNKAVQHKVYNNHNSHDRHPSISNHNDMEVLEFANNPMYDYNNYTYDRYYFNNNKNGNSNDTSNVRYFDSVRSTPVAEKMDLFYPQRESFSEGRGQRVPRFMGNKFDMYQYPSTSYSLPIPMSNQQESNLYVKHIPLSWTDEDLYDFYKSFGEIISVKVITVGGSKNKYRQQSNDSSSDNDLPVGSSRGYGFVSFESPLDAAKAILNTDGYQVSKDQVLSVSFAQKRGNLSSSDDDDQSQTDNSSKFQNFQPHNDYHKAYPTKYNKKFINALMTQNQSQQQVSRENYFIPLQYPNTNTKPVNSYNLISANQNNANWMMPMFPSFGFIPQVPPVPYIIPPQNPAANHIPIMANGSNEEEEFSSGDYSMDY

SEQ ID NO: 193 - DNA, 1898 bp, Saccharomyces cerevisiae
ggtaaaagaaatgatcagggagcgtttcttgcaacagcagcaacagtacaggcagcaacagcagaaggatggcaattacgtaaagccctctcaggacaacgtggatagcaaggactaaccgagacagattgaggtctttcatgcattaccaccagtaataatattatacggaataatatagtttatataatatccataatcataatcataatcataatcataatcataatcgtgatattgtaccagccccgcttctccccttttgaactaccattattatcggaccctctttacctttgaatggctcagtaaggacctttgcgcagccgtaagggggtcgggaatacatttccggggttgatcctcgaggaaaagtgctatctatataaggagaagcccttctagatccaaatatcaggggtaactcttcacaactggccaggaacatattccaagttaaaaagaaaaaataattattagaaaccaattaccaacacaagatgctaagatcaaatttatgcagaggatctcgaatccttgcaagactgaccactacaccaaggacatacacatctgcggcgacagctgcggctgcgaatcggggacatatcatcaaaacatacttcaatagagattctacgacaattacgttctccatggaggagtccagcaagccggtttccgtttgctttaacaacgtttttcttagagatgcctcccatagtgccaagctggtgaccacgggagaactgtatcataacgagaaattgaccgctcctcaggacattcaaatttctgaggacggaaaatctctagtggtgaaatggaaagatggcggtcatcaccagttccctttacaattctttatcgactataaaggttccagttttgtttcgccagcaacaagaaaacaagaatccagatatagaccccagttatggaataagcgcatcctgaaagataacgtcaaggacttactttctgtgagctacaacgagtttattgatcctaaggatgactccaagcttttccaaacgctggtcaacctacaaaagtttggtatcgctttcatttccggtactccttcatcctcctctgaaggccttaccatacaaaagatctgtgaaaggatcggacccataagatcgactgtacatggtgaaggtacatttgacgtgaatgcatcccaagcgacaagtgttaatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatctggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataa

SEQ ID NO: 194 - protein, 465 aa, Saccharomyces cerevisiae
MLRSNLCRGSRILARLTTTPRTYTSAATAAAANRGHIIKTYFNRDSTTITFSMEESSKPVSVCFNNVFLRDASHSAKLVTTGELYHNEKLTAPQDIQISEDGKSLVVKWKDGGHHQFPLQFFIDYKGSSFVSPATRKQESRYRPQLWNKRILKDNVKDLLSVSYNEFIDPKDDSKLFQTLVNLQKFGIAFISGTPSSSSEGLTIQKICERIGPIRSTVHGEGTFDVNASQATSVNAHYANKDLPLHTDLPFLENVPGFQILQSLPATEGEDPNTRPMNYFVDAFYATRNVRESDFEAYEALQIVPVNYIYENGDKRYYQSKPLIEHHDINEDNTLLGNYEALIKCINYSPPYQAPFTFGIYDKPSDLNNNLDLNLITTPAKLTERFLFKSFIRGLNLFESHINDFNNQFRLQLPENCCVIFNNRRILHANSLTSSNQQWLKGCYFDSDTFKSKLKFLEEKFPHDK

SEQ ID NO: 195 - DNA, 797 bp, Saccharomyces cerevisiae
ttctattccggcttataaaaagcatggaatccaaaagaattaggcttctcattctattttaattatactagtacgatttctcactctgtaatttaatatcagtgtaatatgcacctagttatgggtagtttttgctaacgttacgagccgcgaaactgtcctcaatcttcaccactacctctaatgactgaagaatgctatgcgatataacgctgtcgcactttgaatatatacttatatttacatagttttcaagtgcgtattactattgcaaagtagtattttgtcacgtgattttgatccaattaaaactaaatatggttcaacccgttgtttccgcatcaaaaaaccataccatttatcaaggggacgggatatatcacataacagtttgaatgcataatttgttatagatatcttctggaataatcttcacagcaaaagcgcaagtcgaataatatatcgataaatacaatccataagacttaaaactaacctcaatggcggtaagtatcctatcatattatgtgagctagaaccgaattagtatactaacatttataatacagtacacttctcatctgtcttcaaaaactggtctacatttcggtagactttctttaagaagtttaacagcttatgctccgaatttaatgttatggggtggtgctagcatgcttgggctatttgtattcacagaaggatggcctaagtttcaagatacgctatacaaaaagattccgttgttaggacctacattggaagatcatactccaccagaagataaacctaattga

SEQ ID NO: 196 - protein, 77 aa, Saccharomyces cerevisiae
MAYTSHLSSKTGLHFGRLSLRSLTAYAPNLMLWGGASMLGLFVFTEGWPKFQDTLYKKIPLLGPTLEDHTPPEDKPN

SEQ ID NO: 197 - DNA, 1007 bp, Saccharomyces cerevisiae
gtacatgcaccattcgcttcaactgcgtcagatagttgtagtccctctggacataagcatttcgttcgtgcttgtcgtcgtccgcctgtttcaacgcctcactcgatatatactccttaggatcatgtgtttgacctgagcaattgtcccttgtcttgtgcttcttggaacactccaaagagcaagtttgcaccaaacatcttggacacttgtatttgaactcttttattccgcatacaccacacaacaccgccatacttgcaaattgccacacccttccctattaactggactcctattccagctcatctcatcgaatatgaactttgacatccactattattaccgcgaatttttttttttttcaatttgttaccctgccttgggtatcaaaaatttcatctctaaaagggagcgtgatagataaagcaatcacaccttaaacaatacatttttttttttcctgcaatctccaaagtgtgcaaggtatacaaagcagaatggtatgtgccattacattacgtgtcaacacttctgtctctaacaagcgttcttactaacatgaaaaacttttttaaaactgtgctctcttgttggactggtacctcgtgacaaaggtattggttttttcattgttgctcagaactatgtaatattctctttagtcccaaaaaaacggaattgccaccctactacaagctgaaaaggaagcccacgaaatagtatcaaaggctagaaagtacagacaagataagttgaagcaagccaagactgatgcagccaaggaaatcgactcatacaaaattcaaaaagacaaggaattgaaggagtttgaacaaaagaatgccggtggtgttggtgaattggaaaagaaagcagaggctggtgtgcaaggtgaattagctgagattaagaaaattgcagagaagaaaaaggatgacgttgtcaaaattttgatcgagactgtcatcaagccttctgctgaagtccatatcaatgccttgtaa

SEQ ID NO: 198 - protein, 114 aa, Saccharomyces cerevisiae
MSQKNGIATLLQAEKEAHEIVSKARKYRQDKLKQAKTDAAKEIDSYKIQKDKELKEFEQKNAGGVGELEKKAEAGVQGELAEIKKIAEKKKDDVVKILIETVIKPSAEVHINAL

SEQ ID NO: 199 - DNA, 686 bp, Saccharomyces cerevisiae
aacttcaacgatttctatgatgcattttataattagtaagccgatcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaaatgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaatga

SEQ ID NO: 200 - protein, 61 aa, Saccharomyces cerevisiae
MFSELINFQNEGHECQCQCGSCKNNEQCQKSCSCPTGCNSDDKCPCGNKSEETKKSCCSGK

SEQ ID NO: 201 - DNA, 686 bp, Saccharomyces cerevisiae; identical to SEQ ID NO: 199

SEQ ID NO: 202 - protein, 61 aa, Saccharomyces cerevisiae; identical to SEQ ID NO: 200

SEQ ID NO: 203 - DNA, 2999 bp, Saccharomyces cerevisiae
atgtatagttaaaggtaaattaactagagaacgtgggaacagttccgcactgtgaccaccggaacgtacgtctggttagcgcagcattagtcccagttacatccgattcaaaatgcaacagcaagtattaattggggaaatcatatcattttgaatataaccttggcgtcctactaaggatggttatacatcctagctcgtgtagtgtgatattttgcaggaatgatgcaaagagaggaagaacaagaagagagttgttgtttttaatgtatcttagcaatttatgagaggagcattgtcgttgtctgctgtgactagtgcgtagctttgccgtttgtttttaatcatgatggacatgcaagtgagaaaagtgaggaagccgcctgcttgcacccaatgcaggaagagaaagatcgggtgcgacagggccaaaaccgatatgtgggaattgcgtcaagtataacaagccggactgtttttatccagatggacctggtaagatggtcgctgtgccctctgcgtccgggatgtccacgcacggcaatggccaaggttccaaccattttagtcagggaaacggtgtaaatcagaaaaacgtaatgattcaaacgcagtatccgattatgcaaacgtcgatagaggcattcaacttctcgttcaacccctctgtggatactgcgatgcagtggaccaaggccgctagctaccagaataataacaccaataataatactgctcctcgtcagaatagtagtaccgttagtagtaatgttcatggaaacactattgtgagaagcgatagtccagatgtgccctccatggatcagattagagaatataacacacgattacaactggttaacgctcaaagttttgactatacagataacccatactcttttaatgttggtatcaatcaagactcggccgttttcgatctaatgacttctccgtttactcaagaggaagtattaatcaaggagatagactttttaaaaaacaaattgcttgatttacaaagcttgcaactgaaaagtttgaaagaaaaatcgaatttaaatgccgacaataccacggcaaacaaaattaacaaaacaggtgagaattctaagaaaggcaaggttgacggtaaaagagccggatttgatcatcagacttcaaggacttctcagtcctcacaaaaatactttacagcgctcacaataacagatgtgcaaagtttagtccaagtgaaaccgttgaaggatacccccaactaccttttcactaaaaacttcatcatttttagagatcattatcttttcaagttctataatattttgcacgatatctgccatattaatcagttcaaagtaagtcctcctaacaataaaaatcaccaacaatatatggaagtttgcaaagttaacttcccaccaaaagcaataattattgagacactaaactctgaatcccttaacaatctgaatattgaagaatttttgccaatctttgacaaaaccctcttactagaatttgttcataactcttttccaaatggtgatacctgtccttcattctcaacggtcgatcttcctttatctcaactgaccaaactaggcgaattaactgtgcttctactgttgttaaacgattcaatgaccctattcaataagcaggctattaataaccatgtttcggcattaatgaataatttgaggttgattcgaagccaaatcacattgataaacctggaatattatgaccaagagacaatcaaatttattgccatcacaaaattttatgaatctctgtacatgcatgatgatcataaatcaagtttagacgaagatttgagctgtctgttaagcttccagataaaagatttcaagttattccattttttgaaaaaaatgtattactcaagacattcgcttctaggtcagtcttcattcatggtacccgctgctgaaaacctatctccgatacctgcctctattgatacgaacgacattcctttaattgctaacgatttaaaattactggaaacgcaagcaaaattgataaatattctgcaaggtgttcctttctacttgccagtaaatttaaccaaaattgaaagtctgttagaaaccttgactatgggcgtgagtaatacagtagacttatattttcatgacaacgaagtcagaaaagaatggaaagacactttaaattttatcaataccattgtttatacaaattttttcctttttgttcaaaacgaatcctctttgtccatggcagttcaacattcttctaacaacaataagacctcgaactctgaaagatgtgcaaaggatctgatgaaaattatttctaatatgcacattttttactcaataacatttaattttatcttccccataaagtcgataaagtcattttcaagcggcaataatcgctttcattctaatggtaaagaatttttattcgcaaatcattttattgaaatcttacagaattttatagcaatcacatttgctattttccaacgttgtgaagtaatattatatgacgaattttacaaaaatctttcaaatgaggagattaatgttcaattgctattgattcatgacaagattttggaaattttaaaaaaaatagaaattatcgtatcctttttacgagatgaaatgaatagcaacggaagtttcaaatctattaaaggtttcaacaaggttttgaatctgattaaatatatgctgagatttagcaagaaaaaacaaaattttgcgagaaactctgataacaataatgttacagattatagtcagtcggcgaagaacaaaaatgttctcttgaaattccccgttagtgaactgaacagaatctatttaaaatttaaggagatttcagattttttaatggaaagagaagttgtccaaaggagtataattattgacaaggatttggaatctgataatctgggtattactacggcaaacttcaacgatttctatgatgcattttataattag

SEQ ID NO: 204 - protein, 832 aa, Saccharomyces cerevisiae
MVAVPSASGMSTHGNGQGSNHFSQGNGVNQKNVMIQTQYPIMQTSIEAFNFSFNPSVDTAMQWTKAASYQNNNTNNNTAPRQNSSTVSSNVHGNTIVRSDSPDVPSMDQIREYNTRLQLVNAQSFDYTDNPYSFNVGINQDSAVFDLMTSPFTQEEVLIKEIDFLKNKLLDLQSLQLKSLKEKSNLNADNTTANKINKTGENSKKGKVDGKRAGFDHQTSRTSQSSQKYFTALTITDVQSLVQVKPLKDTPNYLFTKNFIIFRDHYLFKFYNILHDICHINQFKVSPPNNKNHQQYMEVCKVNFPPKAIIIETLNSESLNNLNIEEFLPIFDKTLLLEFVHNSFPNGDTCPSFSTVDLPLSQLTKLGELTVLLLLLNDSMTLFNKQAINNHVSALMNNLRLIRSQITLINLEYYDQETIKFIAITKFYESLYMHDDHKSSLDEDLSCLLSFQIKDFKLFHFLKKMYYSRHSLLGQSSFMVPAAENLSPIPASIDTNDIPLIANDLKLLETQAKLINILQGVPFYLPVNLTKIESLLETLTMGVSNTVDLYFHDNEVRKEWKDTLNFINTIVYTNFFLFVQNESSLSMAVQHSSNNNKTSNSERCAKDLMKIISNMHIFYSITFNFIFPIKSIKSFSSGNNRFHSNGKEFLFANHFIEILQNFIAITFAIFQRCEVILYDEFYKNLSNEEINVQLLLIHDKILEILKKIEIIVSFLRDEMNSNGSFKSIKGFNKVLNLIKYMLRFSKKKQNFARNSDNNNVTDYSQSAKNKNVLLKFPVSELNRIYLKFKEISDFLMEREVVQRSIIIDKDLESDNLGITTANFNDFYDAFYN

SEQ ID NO: 205 - DNA, 2213 bp, Saccharomyces cerevisiae
gcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgccgatcttttgtctttcagatatatgagaaaaagaatattcatcaagtgctgatagaagaataccactcatatgacgtgggcagaagacagcaaacgtaaacatgagctgctgcgacatttgatggcttttatccgacaagccaggaaactccaccattatctaatgtagcaaaatatttcttaacacccgaagttgcgtgtccccctcacgtttttaatcatttgaattagtatattgaaattatatataaaggcaacaatgtccccataatcaattccatctggggtctcatgttctttccccaccttaaaatctataaagatatcataatcgtcaactagttgatatacgtaaaatcatgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataa

SEQ ID NO: 206 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 207 - DNA, 935 bp, Saccharomyces cerevisiae
gacaccttttccggtgtttggaggggcaacggcgggttgcacttgactttcacttaagttgtcgtgaaaactttcatttttaccttctggagtattcatggcctttgaacgaccagattccaattcatatgagttggatgaattggatttctgaggagatattagatcgggagttgaattcatgattttacgtatatcaactagttgacgattatgatatctttatagattttaaggtggggaaagaacatgagaccccagatggaattgattatggggacattgttgcctttatatataatttcaatatactaattcaaatgattaaaaacgtgagggggacacgcaacttcgggtgttaagaaatattttgctacattagataatggtggagtttcctggcttgtcggataaaagccatcaaatgtcgcagcagctcatgtttacgtttgctgtcttctgcccacgtcatatgagtggtattcttctatcagcacttgatgaatattctttttctcatatatctgaaagacaaaagatcggcacggcaatgccctgcagcatttcttcctagtttttccgaatttccattacgtattggatcttgtgcgcatatttgtcagtccttcacggaaaaaaaaaaagagcactgggtcacttcggaaaaacttttgactcaatgcaacagtgtcataatcctttgcgctgtctctttgaagaaaaatcaggagtgcaagatatcgattaattccttggaagttatgatggttagtcttagtttaactctcttgaagaagggttttttcagttggtcaacactctttagaggtaaaaaaaaaaaaaaaaaaaaaaaaaagagaattcttcatgtaatttaccatgattctacgtttttgcaagcaaaaatgaagataatccgagcgcatgcgaagtag

SEQ ID NO: 208 - protein, 144 aa, Saccharomyces cerevisiae
MNILFLIYLKDKRSARQCPAAFLPSFSEFPLRIGSCAHICQSFTEKKKEHWVTSEKLLTQCNSVIILCAVSLKKNQECKISINSLEVMMVSLSLTLLKKGFFSWSTLFRGKKKKKKKKKRILHVIYHDSTFLQAKMKIIRAHAK

SEQ ID NO: 209 - DNA, 845 bp, Saccharomyces cerevisiae
ctacgaaaataagcaaaaaataaataaaataaaaacaaaaacaaaaacaaaaacaaaaacaaaaacaaaaacaaaaacacatattgttatgatgactggacgaaagaaagatcgtcgttactttcctaattgtttgtcttcagtacagttattatcagtgttctctttcttttttattgtactatgtgatgttactgatacatcacgcgcttcctttatgttttctttttttatgttcgttacaggatttatagtttttacagtatattgacttcaataatttctaatattcagttcctattaaatttgattattccgattagatcggtcggcgctaccaaaaagaggcgaagaaaagaggaaaacgcaagtggataaaggggtggggggcaaaagtatttaagaaaaagcgatgcgatggagagaacaaatggataagttgcgtttcctcgttatattacaacatttaaatctattgtgtaacagactatagcatatatatgaaggccagttacttagttttgattttcattagcatattctccatggcacaggcatcttccttatcatcatacatcgtaactttccccaagacggataatatggctacggaccagaatagcattattgaagatgtcaaaaaatatgtggtggacatagggggtaaaataacacacgaatatagcttgataaagggctttacagtggacttacctgatagcgaccaaattttggacggtctgaaagaacgtttgagctatattgaaagcgagtacggtgctaaatgcaatttggaaaaggattcagaagttcatgctctaaaccgtgaccatttagttgcttag

SEQ ID NO: 210 - protein, 114 aa, Saccharomyces cerevisiae
MKASYLVLIFISIFSMAQASSLSSYIVTFPKTDNMATDQNSIIEDVKKYVVDIGGKITHEYSLIKGFTVDLPDSDQILDGLKERLSYIESEYGAKCNLEKDSEVHALNRDHLVA

SEQ ID NO: 211 - DNA, 2414 bp, Saccharomyces cerevisiae
gtcatgcgcgcaataggaaagcgcacgaaacaaatgagtaattcgtaggaaacaatgcagcccccagggtcagcaactgacgtgactcagcctggcttttgtagaaaaagatgacgccctggcagagaggtgggggaattgaggggtcctcgctacccaccttaagtatggaagaatatgatgaagaatatgatgataactcttggaagcgagcggcgggttccatcactttttacggattggtaacacaggggcctcagttcgatacttggtattcaggcttccagcgttggtgagtttagttagcggtatggtatgcacatggtgttgatgcttggtggtaatcattcgttaggtgaattgagcagtagcgatattagatatatttagtattttatagcgtctttttggtgggggaggaaggacaaaacctgtctcgtaaatataaagggactgttcgatatcgcagatactagagtataaatttcgattgaggcgagatgacaacatatttcaagttggtaaaaggtgctaccaagatcaagtcagccccgcccaaacagaagtatctggatccgatactgttggggaccagcaatgaagaggatttctatgagatcgtgaagggtttggattcccgaattaatgacacggcgtggactattgtgtataaatcgctgttggtggttcatttgatgataagggagggttccaaagatgttgcattgcggtactactctaggaacctggagttttttgacattgaaaacatacgtggctccaatggcagtgcgtctggagacatgagggcacttgatagatacgataattatctgaaggtgagatgcagggagtttggtaaaatcaaaaaggactatgtgagagacggctatcgaacactgaagctgaacagtggcaattacggaagctccagaaacaagcaacactctatcaatatagcactagatcatgtggagtccctagaggtacaaatacaagccctgattaaaaacaagtatacacaatatgatttgagtaacgaattgatcatatttggtttcaagctgcttattcaagacctgctagcgctatataatgctctcaacgaaggtatcataactctgctggagtcttttttcgaactatctcatcataatgcagagagaactctagacctgtacaagacgtttgttgatttgaccgagcacgttgtcaggtacttgaagagcgggaagactgcgggcttgaaaatacccgtcatcaagcatatcactaccaaactggtcagatcgctagaagaacatctgatagaggatgataagacgcacaacacttttgtgcccgttgacagttctcaaggaagtgctggggccgtagtagccaaatctactgcacaggaaaggttggagcaaatccgggaacaaaaaaggatactagaggcacaattgaaaaacgaacaagtagcgatttcccctgctctaactactgtcacggcggctcaatcttacaacccgtttggaacagactcttctatgcatactaacattccaatggctgtggctaatcaaacgcaacagatcgcaaataacccatttgtatctcaaactcagccacaggtgatgaatacaccaaccgctcatacagagcccgcaaatttaaacgttcctgaatatgcagcggtccaacacacagtgaacttcaaccctgtacaagatgctggcgtaagtgcccaacaaacggggtactattcgattaacaaccatttaacacccacatttacaggtgcagggtttggaggatactccgtttcacaggatacaactgccgcttctaatcaacaagtctctcattcacaaactggttctaacaacccgttcgcattgcacaacgccgcgacgatcgcaacagggaatcctgcacacgaaaatgtcttaaataacccattttcacgaccaaactttgatgaacaaaataccaatatgccgctacaacaacagataataagtaacccttttcaaaaccaaacgtacaatcaacaacaatttcaacaacaaaaaatgcctttgagctcgatcaatagcgttatgacaacccctactagcatgcagggatcgatgaatattcctcagcgttttgataaaatggaatttcaggctcactacactcagaatcatctccaacaacagcaacaacagcaacagcaacaacagcaacagcaacaacagcaaccacaacagggttattatgtgcctgcaactgcaggagccaaccctgttacaaatataactgggacagttcaacctcaaaatttccctttctatccacaacagcaaccacaaccggaacagtctcaaacacagcaaccagttttaggaaaccaatatgctaacaacctcaatttaattgatatgtaa

SEQ ID NO: 212 - protein, 637 aa, Saccharomyces cerevisiae
MTTYFKLVKGATKIKSAPPKQKYLDPILLGTSNEEDFYEIVKGLDSRINDTAWTIVYKSLLVVHLMIREGSKDVALRYYSRNLEFFDIENIRGSNGSASGDMRALDRYDNYLKVRCREFGKIKKDYVRDGYRTLKLNSGNYGSSRNKQHSINIALDHVESLEVQIQALIKNKYTQYDLSNELIIFGFKLLIQDLLALYNALNEGIITLLESFFELSHHNAERTLDLYKTFVDLTEHVVRYLKSGKTAGLKIPVIKHITTKLVRSLEEHLIEDDKTHNTFVPVDSSQGSAGAVVAKSTAQERLEQIREQKRILEAQLKNEQVAISPALTTVTAAQSYNPFGTDSSMHTNIPMAVANQTQQIANNPFVSQTQPQVMNTPTAHTEPANLNVPEYAAVQHTVNFNPVQDAGVSAQQTGYYSINNHLTPTFTGAGFGGYSVSQDTTAASNQQVSHSQTGSNNPFALHNAATIATGNPAHENVLNNPFSRPNFDEQNTNMPLQQQIISNPFQNQTYNQQQFQQQKMPLSSINSVMTTPTSMQGSMNIPQRFDKMEFQAHYTQNHLQQQQQQQQQQQQQQQQQPQQGYYVPATAGANPVTNITGTVQPQNFPFYPQQQPQPEQSQTQQPVLGNQYANNLNLIDM

SEQ ID NO: 213 - DNA, 890 bp, Saccharomyces cerevisiae
cgctcgcttccaagagttatcatcatattcttcatcatattcttccatacttaaggtgggtagcgaggacccctcaattcccccacctctctgccagggcgtcatctttttctacaaaagccaggctgagtcacgtcagttgctgaccctgggggctgcattgtttcctacgaattactcatttgtttcgtgcgctttcctattgcgcgcatgactaggatggaaaaaaaaagaagaaaaagaaaagcgttgagtatataataagaaagaagaaaaagtccgagagaaaagaagcacaaaggtttttcctcgaggaaaacagtaaagtttgatacgcacatcgttgacatcgctgactgcaataggaaactgaaatagacggcaaaccattagttcattcgaaagaacgtattgtcgagaattatcactcactatatcagaaaattgacacacgaattatataaacgaagttatacagaaaaagattaaagaaaagaaaaatgtctacatcatccgtacgttttgcatttaggcggttctggcaaagtgagacaggccccaagacggtgcatttctgggctcctactttgaaatggggtctggttttcgctggattcagcgatatgaagagaccggtggaaaaaatttctggtgctcaaaatttgtcgctgctatctactgcgctgatttggactcgttggtcctttgtcatcaagccaagaaacatcttgttggcttctgtcaactcgtttctttgtctgaccgctggctatcaattgggtagaattgccaactacaggatacggaatggcgactctatatcgcaattgtgtagctatattctcagcggcgccgacgaaagcaaaaaggaaattactacgggcagataa

SEQ ID NO: 214 - protein, 129 aa, Saccharomyces cerevisiae
MSTSSVRFAFRRFWQSETGPKTVHFWAPTLKWGLVFAGFSDMKRPVEKISGAQNLSLLSTALIWTRWSFVIKPRNILLASVNSFLCLTAGYQLGRIANYRIRNGDSISQLCSYILSGADESKKEITTGR

SEQ ID NO: 215 - DNA, 1703 bp, Saccharomyces cerevisiae
atatcttacgtaatgaacttccgtaatgaacttccgtaattcaagatctcttagcatctcttgttcaatcttcagactctactaagtgttcttaccaaccattggatgctcattacaaatgaatgaatatattgcacggaacggaagcggcatgctttttccgtctcgtgtgcttagtaaagcaaaacggagtagaatcggtaagaacttcctttttgggttggaaaatcattgccattgtttggacacctttctttttccgtattgttcgagcaccgcgtttctttttgggtacttgatgaggtagcagattcctggaacgtgctttctctcgaggtaacctgccttgttcctcctggtgactttctaaaatataaaaggaaaagcatatctctagtttcgagttttttcttcatactttatttccttatgttaaacggtccagatatagaataaatcatcatattaagctaaatatagacgataatatagtatcgataatgccatttgttaaggactttaagccacaagctttgggtgacaccaacttattcaaaccaatcaaaattggtaacaatgaacttctacaccgtgctgtcattcctccattgactagaatgagagcccaacatccaggtaatattccaaacagagactgggccgttgaatactacgctcaacgtgctcaaagaccaggaaccttgattatcactgaaggtacctttccctctccacaatctgggggttacgacaatgctccaggtatctggtccgaagaacaaattaaagaatggaccaagattttcaaggctattcatgagaataaatcgttcgcatgggtccaattatgggttctaggttgggctgctttcccagacacccttgctagggatggtttgcgttacgactccgcttctgacaacgtgtatatgaatgcagaacaagaagaaaaggctaagaaggctaacaacccacaacacagtataacaaaggatgaaattaagcaatacgtcaaagaatacgtccaagctgccaaaaactccattgctgctggtgccgatggtgttgaaatccacagcgctaacggttacttgttgaaccagttcttggacccacactccaataacagaaccgatgagtatggtggatccatcgaaaacagagcccgtttcaccttggaagtggttgatgcagttgtcgatgctattggccctgaaaaagtcggtttgagattgtctccatatggtgtcttcaacagtatgtctggtggtgctgaaaccggtattgttgctcaatatgcttatgtcttaggtgaactagaaagaagagctaaagctggcaagcgtttggctttcgtccatctagttgaacctcgtgtcaccaacccatttttaactgaaggtgaaggtgaatacaatggaggtagcaacaaatttgcttattctatctggaagggcccaattattagagctggtaactttgctctgcacccagaagttgtcagagaagaggtgaaggatcctagaacattgatcggttacggtagattttttatctctaatccagatttggttgatcgtttggaaaaagggttaccattaaacaaatatgacagagacactttctacaaaatgtcagctgagggatacattgactaccctacgtacgaagaagctctaaaactcggttgggacaaaaattaa

SEQ ID NO: 216 - protein, 400 aa, Saccharomyces cerevisiae
MPFVKDFKPQALGDTNLFKPIKIGNNELLHRAVIPPLTRMRAQHPGNIPNRDWAVEYYAQRAQRPGTLIITEGTFPSPQSGGYDNAPGIWSEEQIKEWTKIFKAIHENKSFAWVQLWVLGWAAFPDTLARDGLRYDSASDNVYMNAEQEEKAKKANNPQHSITKDEIKQYVKEYVQAAKNSIAAGADGVEIHSANGYLLNQFLDPHSNNRTDEYGGSIENRARFTLEVVDAVVDAIGPEKVGLRLSPYGVFNSMSGGAETGIVAQYAYVLGELERRAKAGKRLAFVHLVEPRVTNPFLTEGEGEYNGGSNKFAYSIWKGPIIRAGNFALHPEVVREEVKDPRTLIGYGRFFISNPDLVDRLEKGLPLNKYDRDTFYKMSAEGYIDYPTYEEALKLGWDKN

SEQ ID NO: 217 - DNA, 995 bp, Saccharomyces cerevisiae
cccaacagatttcaagtctgtcgccttaaccactcggccatagtgcctaaaacaatgtaggttatttaagcaagtattgtagatacttttcgtaataaactacaatgcacccacgactcgcggtgtaatgatggcatgaaatcattgaacgaagttttgcggctatacggctgaaggacgagactaaagggacaggaattattaatgcggggtataatttgaatagtattaacgggcactgccgtttagccatcaaatgctattgttggggtattctctctactttttgttcttggcttgaaccttttcggcggttggcaatcgtccgtatataagcatcggctgtcccaatcctctattgcccttttcccttgcacctccttctcaattcttcgtatctttcgcgtaaaggtagatcttgattcacctatctgtcgaaacacgattaagtgcaaacgaaacaacgtacagtatataacaaagtattttaaataataagaatgacgaaaaaggataagaaagcaaagggtcctaagatgtccaccatcactacaaaaagtggtgagtccttaaaggtttttgaggatttgcatgattttgaaacatatttaaagggtgagacggaagatcaagagttcgaccatgtccattgccaactgaagtactatccaccctttgtcctgcatgatgcgcatgatgatccggaaaagatcaaagagactgccaattcgcactctaagaagtttgttcgccatttacaccagcatgttgagaagcacctgctaaaggacatcaaaaccgctatcaacaagccagaattgaaattccacgataagaaaaagcaggaatcctttgaccggattgtttggaattatggcgaagaaacggagttgaacgccaagaaattcaaggtgtctgtcgaagttgtatgtaaacacgatggcgcaatggtagatgttgattacaagacagaacccttgcagccactcatctaa

SEQ ID NO: 218 - protein, 164 aa, Saccharomyces cerevisiae
MTKKDKKAKGPKMSTITTKSGESLKVFEDLHDFETYLKGETEDQEFDHVHCQLKYYPPFVLHDAHDDPEKIKETANSHSKKFVRHLHQHVEKHLLKDIKTAINKPELKFHDKKKQESFDRIVWNYGEETELNAKKFKVSVEVVCKHDGAMVDVDYKTEPLQPLI

SEQ ID NO: 219 - DNA, 1910 bp, Saccharomyces cerevisiae
tgggagtctttagcaagttcggcaaatatcgatatcaatagtattgctaaataaaccttttttattccatttactgtcgtttatactggctgacccttaattccctagcaatctttgcctgcacccgtaccaggaagcgtgatagaatcggtagctacaaaatttttagcatagttaataagtgctattgtttttcataatgtcacgtgcactatcaataatattacactcttgttcttgccaaatatacacaaaatgccacatttttttctttacaccgaagaatttggccgtcagccggacagcgctcagattaattgtgggctagattcttcacgctggaaacgagtcaccgttatgaaaactaatggaatctcccaggtttaatacataagaaggttacgagctactacattaaaaaatactttgtctgttttagctgtagattattgtaacattaaaaagtaacaaacactgatttcgggtatttcctccctaacatgtcttattcagctgccgataatttacaagattcattccaacgtgccatgaacttttctggctctcctggtgcagtctcaacctcaccaactcagtcatttatgaacacactacctcgtcgtgtaagcattacaaagcaaccaaaggctttaaaacctttttctactggtgacatgaatattctactgttggaaaatgtcaatgcaactgcaatcaaaatcttcaaggatcagggttaccaagtagagttccacaagtcttctctacctgaggatgaattgattgaaaaaatcaaagacgtacacgctatcggtataagatccaaaactagattgactgaaaaaatactacagcatgccaggaatctagtttgtattggttgtttttgcataggtaccaatcaagtagacctaaaatatgccgctagtaaaggtattgctgttttcaattcgccattctccaattcaagatccgtagcagaattggtaattggtgagatcattagtttagcaagacaattaggtgatagatccattgaactgcatacaggtacatggaataaagtcgctgctaggtgttgggaagtaagaggaaaaactctcggtattattgggtatggtcacattggttcgcaattatcagttcttgcagaagctatgggcctgcatgtgctatactatgatatcgtgacaattatggccttaggtactgccagacaagtttctacattagatgaattgttgaataaatctgattttgtaacactacatgtaccagctactccagaaactgaaaaaatgttatctgctccacaattcgctgctatgaaggacggggcttatgttattaatgcctcaagaggtactgtcgtggacattccatctctgatccaagccgtcaaggccaacaaaattgcaggtgctgctttagatgtttatccacatgaaccagctaagaacggtgaaggttcatttaacgatgaacttaacagctggacttctgagttggtttcattaccaaatataatcctgacaccacatattggtggctctacagaagaagctcaaagttcaatcggtattgaggtggctactgcattgtccaaatacatcaatgaaggtaactctgtcggttctgtgaacttcccagaagtcagtttgaagtctttggactacgatcaagagaacacagtacgtgtcttgtatattcatcgtaacgttcctggtgttttgaagaccgttaatgatatcttatccgatcataatatcgagaaacagttttctgattctcacggcgagatcgcttatctaatggcagacatctcttctgttaatcaaagtgaaatcaaggatatatatgaaaagttgaaccaaacttctgccaaagtttccatcaggttattatactaa

SEQ ID NO: 220 - protein, 469 aa, Saccharomyces cerevisiae
MSYSAADNLQDSFQRAMNFSGSPGAVSTSPTQSFMNTLPRRVSITKQPKALKPFSTGDMNILLLENVNATAIKIFKDQGYQVEFHKSSLPEDELIEKIKDVHAIGIRSKTRLTEKILQHARNLVCIGCFCIGTNQVDLKYAASKGIAVFNSPFSNSRSVAELVIGEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVSLKSLDYDQENTVRVLYIHRNVPGVLKTVNDILSDHNIEKQFSDSHGEIAYLMADISSVNQSEIKDIYEKLNQTSAKVSIRLLY

SEQ ID NO: 221 - DNA, 992 bp, Saccharomyces cerevisiae
gttttccatgcttttgccggatttcctccaccaacgcttccattcgagacctgtccgtgatgtcgaggacacgatagacaaatttgtctgcaccgtattctctttgcaaagactgcagaccagcttccgttcttgctacgccgtagacgatgcattcatcgtcctcttcgataacagttttcaccaattgcaggccaatcccacgggaggcacctgtaatcaaaataaccttgcccatatcccttctttgacagattataagttgtttctcttgttgctgttcgcgacagcccttatttcctgtattccttcttctttttctgcattatcgtttttagccactttacgaaaaaggtcaaaaagtgaaaaaaagagggaaaaaaccatgaggaacagtatgctcccttaatatcggaaaagcaatagtaataaaaacagcatcagagctttccacgtctctctcttccaagctgtcatctcgtaaagtattcaagtttatcatgtcagaattctataagctagcacctgttgacaagaaaggccaaccattccccttcgaccaattaaagggaaaagtggtgcttatcgttaatgttgcctccaaatgtggattcactcctcaatacaaagaactagaggccttgtacaaacgttataaggacgaaggatttaccatcatcgggttcccatgcaaccagtttggccaccaagaacctggctctgatgaagaaattgcccagttctgccaactgaactatggcgtgactttccccattatgaaaaaaattgacgttaatggtggcaatgaggaccctgtttacaagtttttgaagagccaaaaatccggtatgttgggcttgagaggtatcaaatggaattttgaaaaattcttagtcgataaaaagggtaaagtgtacgaaagatactcttcactaaccaaaccttcttcgttgtccgaaaccatcgaagaacttttgaaagaggtggaatag

SEQ ID NO: 222 - protein, 163 aa, Saccharomyces cerevisiae
MSEFYKLAPVDKKGQPFPFDQLKGKVVLIVNVASKCGFTPQYKELEALYKRYKDEGFTIIGFPCNQFGHQEPGSDEEIAQFCQLNYGVTFPIMKKIDVNGGNEDPVYKFLKSQKSGMLGLRGIKWNFEKFLVDKKGKVYERYSSLTKPSSLSETIEELLKEVE

SEQ ID NO: 223 - DNA, 1688 bp, Saccharomyces cerevisiae
ctgttgaatcatggtaaaagagaaaatcaaaagcacgttgacctggatataacctcagtagatcgaaatgcttcgcagaagagtactgcagagaaacatgatattgagaaaccgacatctaagccgcaatctgcttttaaatttgattgggagtctacggattatttagaccgcgtccaaagagcattcccaaagcctgatacctgatgccatccctctacctcttagctatcaatcattcaactaaactactacatagtatacattagctgtacagtcgtcacatcagacgaatacaaaaggccgggtgaaagcgttgattttgcgtacctttttctttttttcgaaatttttttatttttttttcagcatcatatataaaagaaatctcatctcaaggagaaggaaacagcagatcccaatacacatagtaggaaaaaaaaaggttcgctaaacaaaggactggtgtgtacaagaaactaataaatagtaattgcaatatgtctgaaggtattactgatattgaagaatcccaaattcaaaccaactatgacaaggtcgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtactttctccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctattctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacattgctaccttgttgaactaa

SEQ ID NO: 224 - protein, 395 aa, Saccharomyces cerevisiae
MSEGITDIEESQIQTNYDKVVYKFDDMELDENLLRGVFGYGFEEPSAIQQRAIMPIIEGHDVLAQAQSGTGKTGTFSIAALQRIDTSVKAPQALMLAPTRELALQIQKVVMALAFHMDIKVHACIGGTSFVEDAEGLRDAQIVVGTPGRVFDNIQRRRFRTDKIKMFILDEADEMLSSGFKEQIYQIFTLLPPTTQVVLLSATMPNDVLEVTTKFMRNPVRILVKKDELTLEGIKQFYVNVEEEEYKYECLTDLYDSISVTQAVIFCNTRRKVEELTTKLRNDKFTVSAIYSDLPQQERDTIMKEFRSGSSRILISTDLLARGIDVQQVSLVINYDLPANKENYIHRIGRGGRFGRKGVAINFVTNEDVGAMRELEKFYSTQIEELPSDIATLLN

SEQ ID NO: 225 - DNA, 893 bp, Saccharomyces cerevisiae
tgctgaattatttttgggtataccgatcttcccaggcgcttctgaatataaccaattaacaagaataatagacacgcttggatatcctccatcgtggatgatagatatgggtaaaaactctggaaaatttatgaagaaattggcaccagaagaaagttcttcttctacacaaaagcatcgtatgaaaactattgaagagttttgcagagaatacaatatagtggaaaagcccagtaaacaatattttaagtggagaaagttaccagatattattagaaactacaggtatcctaaaagcatacagaactcccaagaacttatcgaccaagaaatgcagaatagggagtgtttgatccactttttaggcggtgtgctaaatttgaacccgttagaaagatggacaccacaacaagctatgctacaccccttcataacaaagcaggagtttacaggtgagtggtttcctccaggatcgtctttaccgggtccttcagaaaaacatgacgatgcaaaaggccagcaaagtgaatatggaagtgcgaacgactctagtaacaatgcaggccacaactatgtctataatcctagctctgccactggtggtgctgatagcgtcgacattggtgctatcagtaaaaggaaggagaatacatctggcgacatctccaataattttgctgttactcattctgttcaagaagggccaacaagcgcgttcaataaacttcacattgtcgaagaataaatcgttattttgtctgacttttcttaactacccatttcattttattacggcttggtgccataatgatatactaaataaatatgaattttgccttttcttaattttccttatacgtatagtcattacaattaataaagtaacattataa

SEQ ID NO: 226 - protein, 130 aa, Saccharomyces cerevisiae
MTMQKASKVNMEVRTTLVTMQATTMSIILALPLVVLIASTLVLSVKGRRIHLATSPIILLLLILFKKGQQARSINFTLSKNKSLFCLTFLNYPFHFITAWCHNDILNKYEFCLFLIFLIRIVITINKVTL

SEQ ID NO: 227 - DNA, 815 bp, Saccharomyces cerevisiae
agaaagaagttcgtggtattaaccgacggcagcaagttgggtcaatacttgaaggattgcccatatgaagggtatggcgggaaagataagaagaacaatctgaccaagcaaaatgtcacaaatgtccatccaacagaatacggcctttacattttacaaaaacaaatcatcgaggacgttgagtgatttgttggcatgatctaataatagtctcttatataaaccctataataatttcttatttttgccttatattcaggtaaatcaccatctaactgtattatctctcacgtatcttcacttatatggctcagaaaacaccgtacgaaacgaaggggctgcgaaaatgtttctagaaggtaatggcaataatagggatacagatcgatcagatccgcctatataaaagacaacgcaccgaaggtgaacaagatcgcagataaaggtatttacaagggaaaaaagtcagcaaaaacaagagataagataacaagaagaagatgttaaggagggaaacttcaacaatatacaggacacacaaaaaaagcaacagtagtatactcaggagccagcgggaccagactagagtggattccttggtagaggagtctcccatgggcgatttcgggatcaataaccagcctacacagcctggcgtgatatactactttgtagagctgactaatttaggcatacaggaaaacacaagcagtaataataacaacaacaataatcatggtgacgatgaaaacggcagtcgatacggccacggcagcagtctgggtggagacgttcactctcgccgttgttcatga

SEQ ID NO: 228 - protein, 104 aa, Saccharomyces cerevisiae
MLRRETSTIYRTHKKSNSSILRSQRDQTRVDSLVEESPMGDFGINNQPTQPGVIYYFVELTNLGIQENTSSNNNNNNNHGDDENGSRYGHGSSLGGDVHSRRCS

SEQ ID NO: 229 - DNA, 1043 bp, Saccharomyces cerevisiae
tcataaagtctggcggcgtattccttgcacaattttcatatcttcccatatgaatacctgttagtccgtatcaccaagtgtaaactgttctttacaatgagaacatctagagtctttctgatatgcgtaacttctgcctcattaatttaaaaatttcttcatagtaaatagcttatttgcttggagcagatgatcgacatgtatttttaggaacataaactgcctaaatataatagatcagcctaaaaataagaatgccaatcaacaaagttgtatttcctatcttccgatattcgcagtccaccattcagacctctggtgagatagtttgcctgcttttgctcccttccaaagtgctgataaaaacctccgtgattttttgaatactcccctgaatgtctattttaagtatattataaaattagtttaagttggtgcggataacgaaaacttgatgcaaggtaaataaatcaagtatatcatagagttctttcattcatatgctatacacaaggttgttacgtcacaactcacaattcaccaagttttcaggcacatcgcccaatcttggctcaaaacctttattttcgaagggtaatttgtacactagtcttttagtgacaacactgtatgggacaggtctggcatgcctatatctagaatcaaatagcttgaataagtccaaagagcaagaagatccccatgccatcgcagaagacgacattgtaaatatagtccatgacgctcccaatagaatattcaagccagcacttgatacctatcaagagaaagagcttgacttacaaaagagtgacctccataaagtacttcattctttgacgtacagtgatgtctctcaattttcgattgtttgggggtttctcattcaactttcgagcctaataggcaattccaccttaggcaaaaaatccattctttataagggaagtgtcgttagtgttttagggttcccaccgttgatttatatggcacttaaacttaggatgaaacagctggaaaaagctggagtgcgctttgagtaa

SEQ ID NO: 230 - protein, 180 aa, Saccharomyces cerevisiae
MLYTRLLRHNSQFTKFSGTSPNLGSKPLFSKGNLYTSLLVTTLYGTGLACLYLESNSLNKSKEQEDPHAIAEDDIVNIVHDAPNRIFKPALDTYQEKELDLQKSDLHKVLHSLTYSDVSQFSIVWGFLIQLSSLIGNSTLGKKSILYKGSVVSVLGFPPLIYMALKLRMKQLEKAGVRFE

SEQ ID NO: 231 - DNA, 785 bp, Saccharomyces cerevisiae
tgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatagaactaacgctaatcgataaaacattagatttcaaactagataaggaccatgtataagaactatatacttccaatataatatagtataagctttaagatagtatctctcgatctaccgttccacgtgactagtccaaggattttttttaagccaatgaaaatgaagaaatgcgtgatcggaaattacgggtagtacgagaaggaaacttgagccaccccccaaattttattcatataataataggaaaagcaacgacctcatctctcgaacattgtttacttgagcaagtccgattaagagtaagttgtcgtacgttaaatacaaataatcaacaaaacactacacaaaaacttctacgataatgggtcctccaagcggtaaaacttacatgggatggtggggtcacatgggtggtccaaagcaaaaaggtataacctcatatgctgtgtctccatatgctcaaaagccattacaaggtattttccataacgctgtattcaatagttttagaagatttaagtctcaatttctatatgtattaatacctgcgggaatttattggtactggtggaagaacggtaacgagtataatgaatttctgtacagcaaagctggtagagaagagctggaaagagttaatgtttaa

SEQ ID NO: 232 - protein, 94 aa, Saccharomyces cerevisiae
MGPPSGKTYMGWWGHMGGPKQKGITSYAVSPYAQKPLQGIFHNAVFNSFRRFKSQFLYVLIPAGIYWYWWKNGNEYNEFLYSKAGREELERVNV

SEQ ID NO: 233 - DNA, 1349 bp, Saccharomyces cerevisiae
gtatattcaagaagaatgacacaccaaagccaaagccattaaagtagatgatgaacaatgggactacaaaatgaaataaagaaaaaatagaaataggctagaagatcaattattaatcgccctattcttccttattacctacacaaaataaagcagcaacataagaaacaaaaacaaaatgaaaacaaaccaaataaatctatgtaagcatactcatttcaatttgatattcattacttgacttttttgtccttatttgaggctccataagcgcgccatttttccctactcccttttttcgtaaatagtaataatgtgctgaaaagaacaatgaagtagttatcatacatattccgtcgtgtcgatatgaggggaggtgtctctttctttcatcccttgtcgcaacctccaatatataagagcataagcaactgatcttactttagtaattaacttagcatacctagcccgaaggaagaaaaaaaattcacctcaacaacatggttcctaagttttacaaactttcaaacggcttcaaaatcccaagcattgctttgggaacctacgatattccaagatcgcaaacagccgaaattgtgtatgaaggtgtcaagtgcggctaccgtcatttcgatactgctgttctttatggtaatgagaaggaagttggcgatggtatcattaaatggttgaacgaagatccagggaaccataaacgtgaggaaatcttctacactactaaattatggaattcgcaaaacggatataaaagagctaaagctgccattcggcaatgtttgaatgaagtctcgggcttgcaatacatcgatcttcttttgattcattcgccactggaaggttctaaattaaggttggaaacttggcgcgccatgcaagaagcggttgatgaaggattggttaagtctataggggtttccaactatgggaaaaagcacattgatgaacttttgaactggccagaactgaagcacaagccagtggtcaaccaaatcgagatatcaccttggattatgagacaagaattagcagattactgtaaatctaaaggtctcgtcgtcgaagcctttgccccattgtgtcacggctacaaaatgactaatccagatttattaaaagtttgcaaagaggtggaccgtaatccaggtcaagttttgattcgttggtctttacaacacggttatttaccactaccgaagactaaaactgtgaagaggttagaaggtaaccttgcagcctacaactttgaactgtcagacgaacagatgaaatttcttgatcatcctgatgcttatgagcctaccgattgggaatgcacagacgcgccataa

SEQ ID NO: 234 - protein, 282 aa, Saccharomyces cerevisiae
MVPKFYKLSNGFKIPSIALGTYDIPRSQTAEIVYEGVKCGYRHFDTAVLYGNEKEVGDGIIKWLNEDPGNHKREEIFYTTKLWNSQNGYKRAKAAIRQCLNEVSGLQYIDLLLIHSPLEGSKLRLETWRAMQEAVDEGLVKSIGVSNYGKKHIDELLNWPELKHKPVVNQIEISPWIMRQELADYCKSKGLVVEAFAPLCHGYKMTNPDLLKVCKEVDRNPGQVLIRWSLQHGYLPLPKTKTVKRLEGNLAAYNFELSDEQMKFLDHPDAYEPTDWECTDAP

SEQ ID NO: 235 - DNA, 1010 bp, Saccharomyces cerevisiae
gccagtatccctttctgaaataagctaaacccttgcaaccaccaggggtgccgccgtcctaactttccagcctggcagcgcgtcgagtcgccgaatgttgcgggcgctgccccgcccgcaacaccgcgcccgccctgcctcagcttaaccgaaaccacacgggtctgccatcttccatataccctggctcttctttcacaatgcccgctcacaacgccaactgcaaaagaagcccgcccttagtcggttttccccactttgatataacccccccccccccccccccgcatcaactggtaatttaacccaaacaccacggggtcataatttaaaagcgaaaaaccttaaagcgttctcgaagaaatcttcctgtagatgatgtcgtagcaaacttatcttttagagtgtttgtgcttactgcattgtcagatcaaaatttacgtagccgcccttttcaacccctgtcgaagagtagcataacagcagcgtagtgaacgtgcatgttcacaaatacacgtacaatattaatatacaatagtaaggtgatgaacacacacacacacacacacacacacacacacacacacatatatatatatacaggagatcaagttagtgtgaggggacgactactgagtttgaagttctttaaagtgttaaagttatttttcccctctcccacctcgttggcaacctctcacccaccgcttagcagcatgtctccgtacatgaccatacctcagcaatacttatacataagcaagatacgttccaagctgtctcagtgcgcccttactcgacaccaccacagagaacttgatctacgaaaaatggtgggccacgccaatatgctggacaggatcctcgacgaaatagacgaaatcgacagcgaggtagtactgtgtgacgctgccgatggttcttctactgcagaagctcattccgcttccccagcatccagcgactcttctcctctcactaataacatccggcccattagcattatgtga

SEQ ID NO: 236 - protein, 169 aa, Saccharomyces cerevisiae
MFTNTRTILIYNSKVMNTHTHTHTHTHTHIYIYTGDQVSVRGRLLSLKFFKVLKLFFPSPTSLATSHPPLSSMSPYMTIPQQYLYISKIRSKLSQCALTRHHHRELDLRKMVGHANMLDRILDEIDEIDSEVVLCDAADGSSTAEAHSASPASSDSSPLTNNIRPISIM

SEQ ID NO: 237 - DNA, 2717 bp, Saccharomyces cerevisiae
cctgctctagacgaagctagggaggaggcgccgtttgaaaatggcggcaaactaaaagaagttgacaaatgaagtatatattttagcacagaatgtgcattattcaacatgtaaatactaatactgcaatatcgacttataataatgtatagtgatccgtatattaatagatctgtttcaattctttacctttttaggatatccgtcacccgtgattccgtcggaggtgagcactcgcccaaataaataacgggaaatggtggcaaaaagtagtggcgggaaaaggaaaaattttcgttctctcccatataaacgtttcattccttttcctaagtcttttacagtaatttcagaaacattcgtattttatatttgatcttttgaagctacaagaaaaactcttaccaattaccccaaaaaaatcaccatcataaagtacttacatatttatttttgtttggtcgttttctcaatataatctacatcatcatatatatataatgtctacacaatttaggaagtctaatcataatagtcatagtagtaaaaaactaaatcctgcgctaaagtccaaaatagatacgcttacagaattgttccctgactggacgagtgatgatttaattgatatagttcaagaatatgatgatttggaaactataattgataaaattacttccggcgcagtgacaagatgggatgaagtaaagaaacctgctaagaaggaaaaatatgaaaaaaaggagcaacaacactcatatgtccctcaacaacatttgccaaatccagaagatgatattacatataagagttctaataatagcaattcttttacttctacaaagcataacagtagtaacaattatactcaagccagaaataagaagaaggtacaaacaccacgagctcatacaaccgggaaacatgttaatctcgacaaggggaagcacgtaccatccaagcctgtttcaaacactacatcgtgggcagcagctgtttctgtagatactaaacatgacgttcctcaagattcaaatgataacaataatgaagaattagaagcacaagggcaacaagcgcaggagaaaaatcaagaaaaagagcaagaagagcaacaacagcaggaagggcataataacaaagaagaacacaaacaaatagagcaaccttctttatcttcaaagaaaacaacttctaggacatctgcttcacaaccaaagaaaatgtcgtgggctgcaattgctacaccaaagccaaaggctgttaaaaagaccgagtctcctcttgaaaacgttgctgaattgaagaaagaaataagcgatattaagaaggatgaccaaaagtctgaagctagtgaagaaaaagttaatgaacaagaaacatctgcacaagaacaagaggaggagactgctgaaccttctgaagaaaatgaagacagagtccctgaagtggacggagaagaagtccaagaagaagctgaaaaaaaggaacaagtaaaagaagaggaacagacagcggaagagctggaacaagaacaagataatgttgctgctccagaagaagaagttacagttgttgaagaaaaggttgaaattagtgctgttatttcagagcctccagaagatcaagctaatactgtacctcaaccacaacaacaatcccaacaaccacagcaaccacagcaaccacagcaaccacagcaaccacagcaaccacagcaacaacaacaaccacagcaaccacaacaaccacaacaacaactacaacagcaacagcaacagcaacaacaaccagtacaagctcaagctcaagcccaagaagaacaattatctcaaaactactatactcaacaacagcagcaacaatacgctcaacaacagcatcagttacagcaacagtatttgtcccaacaacaacaatatgctcagcaacagcaacagcatccacaacctcaatcacaacaacctcaatcacagcaaagtccacaaagtcaaaaacaagggaacaacgtggctgcccaacagtactacatgtatcaaaaccaatttcctggatattcttatccaggtatgtttgattcacaaggatacgcttacggtcaacaatatcagcaacttgctcaaaacaacgctcaaactagtggtaatgctaaccaatataatttccaacaaggttatggtcaagcaggcgcgaacactgctgctgctaatttgactagtgctgccgctgctgctgccgcttctccagctacagctcacgcccaacctcaacaacaacagccatacggtggctcattcatgccatactacgcccacttttaccaacagtcattcccatatggtcaacctcaatacggtgtagctggtcaatatccataccagttaccaaagaacaattacaactattaccaaactcaaaacggtcaggaacagcaaagtccaaatcaaggtgttgcccagcattctgaagactctcaacagaagcaatcacaacagcaacagcaacagcaacctcaaggtcaaccccaacctgaagttcaaatgcaaaatggccaacctgttaacccacaacaacaaatgcagttccaacaatactatcaattccaacaacaacagcaacaagctgctgccgctgccgctgctgctgcccaacaaggtgtaccatatggctacaacggttatgattacaattctaaaaattcaagaggtttctactaa

SEQ ID NO: 238 - protein, 738 aa, Saccharomyces cerevisiae
MSTQFRKSNHNSHSSKKLNPALKSKIDTLTELFPDWTSDDLIDIVQEYDDLETIIDKITSGAVTRWDEVKKPAKKEKYEKKEQQHSYVPQQHLPNPEDDITYKSSNNSNSFTSTKHNSSNNYTQARNKKKVQTPRAHTTGKHVNLDKGKHVPSKPVSNTTSWAAAVSVDTKHDVPQDSNDNNNEELEAQGQQAQEKNQEKEQEEQQQQEGHNNKEEHKQIEQPSLSSKKTTSRTSASQPKKMSWAAIATPKPKAVKKTESPLENVAELKKEISDIKKDDQKSEASEEKVNEQETSAQEQEEETAEPSEENEDRVPEVDGEEVQEEAEKKEQVKEEEQTAEELEQEQDNVAAPEEEVTVVEEKVEISAVISEPPEDQANTVPQPQQQSQQPQQPQQPQQPQQPQQPQQQQQPQQPQQPQQQLQQQQQQQQQPVQAQAQAQEEQLSQNYYTQQQQQQYAQQQHQLQQQYLSQQQQYAQQQQQHPQPQSQQPQSQQSPQSQKQGNNVAAQQYYMYQNQFPGYSYPGMFDSQGYAYGQQYQQLAQNNAQTSGNANQYNFQQGYGQAGANTAAANLTSAAAAAAASPATAHAQPQQQQPYGGSFMPYYAHFYQQSFPYGQPQYGVAGQYPYQLPKNNYNYYQTQNGQEQQSPNQGVAQHSEDSQQKQSQQQQQQQPQGQPQPEVQMQNGQPVNPQQQMQFQQYYQFQQQQQQAAAAAAAAAQQGVPYGYNGYDYNSKNSRGFY

SEQ ID NO: 239 - DNA, 1580 bp, Saccharomyces cerevisiae
tgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaaatgggtgttgaacaaatcttaaagagaaagaccggtgtcatcgttggtgaagatgtccacaacttattcacttacgctaaggaacacaagttcgctattccagctattaacgtcacctcttcttctactgccgtcgctgctttagaagctgctagagacagcaagtccccaatcattttgcaaacctctaacggtggtgctgcttacttcgctggtaagggtatctctaacgaaggtcaaaatgcttccatcaagggtgctattgccgctgcccactacatcagatccattgctccagcttacggtatcccagttgtcttacactctgaccactgtgccaagaagttgttgccatggttcgatggtatgttggaagctgatgaagcttacttcaaggaacacggtgaaccattattctcctcccacatgttggatttgtctgaagaaaccgatgaagaaaacatctctacttgtgtcaagtacttcaagagaatggccgctatggaccaatggttagaaatggaaatcggtattaccggtggtgaagaagatggtgttaacaacgaaaacgctgacaaggaagacttgtacaccaagccagaacaagtttacaacgtctacaaggctttgcacccaatctctccaaacttctccattgctgctgctttcggtaactgtcacggtttgtacgctggtgacatcgctttgagaccagaaatcttggctgaacaccaaaagtacaccagagaacaagttggttgcaaggaagaaaagccattgttcttggtcttccacggtggttccggttctactgtccaagaattccacactggtattgacaacggtgttgtcaaggtcaacttggacactgactgtcaatacgcttacttgactggtatcagagactacgtcttgaacaagaaggactacataatgtccccagtcggtaacccagaaggtccagaaaagccaaacaagaagttcttcgacccaagagtctgggttagagaaggtgaaaagaccatgggtgctaagatcaccaagtctttggaaactttccgtaccactaacactttataa

SEQ ID NO: 240 - protein, 359 aa, Saccharomyces cerevisiae
MGVEQILKRKTGVIVGEDVHNLFTYAKEHKFAIPAINVTSSSTAVAALEAARDSKSPIILQTSNGGAAYFAGKGISNEGQNASIKGAIAAAHYIRSIAPAYGIPVVLHSDHCAKKLLPWFDGMLEADEAYFKEHGEPLFSSHMLDLSEETDEENISTCVKYFKRMAAMDQWLEMEIGITGGEEDGVNNENADKEDLYTKPEQVYNVYKALHPISPNFSIAAAFGNCHGLYAGDIALRPEILAEHQKYTREQVGCKEEKPLFLVFHGGSGSTVQEFHTGIDNGVVKVNLDTDCQYAYLTGIRDYVLNKKDYIMSPVGNPEGPEKPNKKFFDPRVWVREGEKTMGAKITKSLETFRTTNTL

SEQ ID NO: 241 - DNA, 1121 bp, Saccharomyces cerevisiae
ctgggctaggtttcacatatcaaaaagaagttatggcttatgtgctctttctaagtttgactttatgccaaaaatttctccgtagatcgccgcccgttgaagcagcagaatattttaagtgcgccataaaaacctagatagaaaagaagggagagaacataaacgcagaacaccactacttttaaggcgtacgcaaactgttgggcttatctatattgtactatctacctacttgcaacgtcttttacctcctcgatacgtactgcttatgccctgaacaatttacatgtaacccgcagctgcatgctatatcacaggatacgttaacataaagggggcgctactaaaccctctggcgcagtgcaaaaatagaaatatatgccaagtgggaccttgtatagtttctggtttaaagctattcgttcattgcaacgctcctttctgctatcctttcgcaaagtggcaagtactgaaaaccgagaagaataaataatattgcgatgagtttatactttacgacattatttttattgctcactgttgaggtggtaatgctcttcatcttcgttttgcctttgccattccggatccgtaggggtatttttagcacctataaccaattgacagcgaagcagcaaataaaaactataatctttataacgggttgtcttgttggcctgttgtttattgattcatggaaaaggtctcaaattcgtgtttcattataccacaacgacaacagtggctcaatcgggtcatctgctgtaactccaatacaggcactagcatcaagagcgtacaatcaaagaaatatgtatatttccgggttcatattgtacttttctatctgtatcccaactgtcatgtctattgtcaagagactggtgaaataccaaggcttaatcaacgaacaagaaaagcaaaaattgaacaaaccttcctcaaacagcaagaaagactcaaatgaagctgattccaccaaacttcaagaggaactaaggaaaaagcaaatttctctggagggcctacaaaagcaagtcaaaaacctggagaaatattttgatgagaagaatcaacctggaaatgtagcagctgctgaagcttccaagaaaggaaactaa

SEQ ID NO: 242 - protein, 206 aa, Saccharomyces cerevisiae
MSLYFTTLFLLLTVEVVMLFIFVLPLPFRIRRGIFSTYNQLTAKQQIKTIIFITGCLVGLLFIDSWKRSQIRVSLYHNDNSGSIGSSAVTPIQALASRAYNQRNMYISGFILYFSICIPTVMSIVKRLVKYQGLINEQEKQKLNKPSSNSKKDSNEADSTKLQEELRKKQISLEGLQKQVKNLEKYFDEKNQPGNVAAAEASKKGN

SEQ ID NO: 243 - DNA, 944 bp, Saccharomyces cerevisiae
gaaaaacatctcataaatcatccctggaaaaatgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatgaataacttatggcatgggagggtacatatgagcgccttttttttctcgctttgggcagctcatatcatgttccctcactagctaataatataatgaattttttagaaggagcacgattatataaaaaaaataccacttatgttgctacccttatatacgaatttataatacttaatgacgcttcaatgacgcctgatgtcaaatgcttttggctcccagtgaaattgccacacttccttcttctttccgaactttatagtatcatcgaaaaatacaagttggcaaaggtctattacaatcgcggaacgtacgatgttcatacggtttcagcgaatagtcttgtaatatccggaagcatgcctaccggcattattataggtagttcatcgcccttggactatgtaggggtacaagtaaataggcaacttgaaatggatctccctattgaatga

SEQ ID NO: 244 - protein, 147 aa, Saccharomyces cerevisiae
MAWEGTYERLFFLALGSSYHVPSLANNIMNFLEGARLYKKNTTYVATLIYEFIILNDASMTPDVKCFWLPVKLPHFLLLSELYSIIEKYKLAKVYYNRGTYDVHTVSANSLVISGSMPTGIIIGSSSPLDYVGVQVNRQLEMDLPIE

SEQ ID NO: 245 - DNA, 779 bp, Saccharomyces cerevisiae
agctccgaagggcaattccacaggcactccgcggggcccggccaaggcccaaaaggcgtggaatatgcgcgttttggggccataacacccagtaccacggccggaacgggccatataataagtttttcactctcaagaatggtaaacgtaaataggaacatcccactaccctagaaattgcggaaatttcgcgcttatcattagaaaatctggaaccgtcctttttcctctttcttgcatttccctttccgtattattgccattctttaactgcatttggggaaccgtagaccaaaagccaaacagagaaatgtaacgttctaaaaaaaaaacaacgaaaaaattgaaaaataagatacaataatcgtatataaatcaggcttcttgttcatcattttcaattctcttcttgccatcccttttcctatctttgttcttttcttctcataatcaagaataaataacttcatcacattcgctacacactaacaagaaaaaaaatgcaattctctactgtcgcttccgttgctttcgtcgctttggctaactttgttgccgctgaatccgctgccgccatttctcaaatcactgacggtcaaatccaagctactaccactgctaccaccgaagctaccaccactgctgccccatcttccaccgttgaaactgtttctccatccagcaccgaaactatctctcaacaaactgaaaatggtgctgctaaggccgctgtcggtatgggtgccggtgctctagctgctgctgctatgttgttataa

SEQ ID NO: 246 - protein, 92 aa, Saccharomyces cerevisiae
MQFSTVASVAFVALANFVAAESAAAISQITDGQIQATTTATTEATTTAAPSSTVETVSPSSTETISQQTENGAAKAAVGMGAGALAAAAMLL

SEQ ID NO: 247 - DNA, 1151 bp, Saccharomyces cerevisiae
ttatagaactgttttattgtttaaaagagcttgttatagtaatctaagtggaaatacactaacagtaaatagggcgtgtggcgtagtcggtagcgcgctcccttagcatgggagaggtctccggttcgattccggactcgtccaatctttttatacttattaataatttttttcctgccgttacttgcttttaaaataactgccttttatgaatacagagtataatttttgatatacaaagaggttgactgtgataatcaatacttaatttgtggttattggtacacatatacctacaaaagttaccaacaaactgttcgacttttaatgctacccgccttccgagtgtttttgaaggggcggagaggagcggcaagaattagcatggaaaaaagcataaaaagacgaaatgggtggcaatgtattaacttgttcgagaaacctagtggactcaattcattacaacaacaagttcccaagatcatcgattcataatagtcatgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaa

SEQ ID NO: 248 - protein, 216 aa, Saccharomyces cerevisiae
MSDKVINPQVAWAQRSSTTDPERNYVLITVSIADCDAPELTIKPSYIELKAQSKPHVGDENVHHYQLHIDLYKEIIPEKTMHKVANGQHYFLKLYKKDLESEYWPRLTKEKVKYPYIKTDFDKWVDEDEQDEVEAEGNDAAQGMDFSQMMGGAGGAGGAGGMDFSQMMGGAGGAGSPDMAQLQQLLAQSGGNLDMGDFKENDEEDEEEEIEPEVKA

SEQ ID NO: 249 - DNA, 1409 bp, Saccharomyces cerevisiae
cccatcacatcgcatcacatcacatcactccctattctgccctttacagcgcaaaggagtcgtgtgtgggtgtgtgctccttttgacgatcataagagtccatttctagtatgcaagctggtaacaataggtgaatgaattaggttcatttgcgatgaccttcagtatccctccacgcaatgctaaactatccccctcattatgacgcctatatcgtataaggaacttgttacccctgacaattcaaacttcaaaggtctaagaccaaacaagcgtaggaactatcgctcggagtgtttctccgtttgaaaaaagaagagaaataagggcccttgattggtgtcttgtcgagagaggtacgtatataagaatgcagtttgctcgcaatgcccgcttgtgttaagtactcttaccttttccctcaatactaacgttttgaagcagccaaactaacaatagtataacgtatataggttaaaataatattccaagtcaaaaacatgttttccagattatccagatctcactcaaaagcattaccgattgctctaggtacagttgctatagcagctgctaccgcattctattttgcaaaccgtaaccaacattcctttgtcttcaatgaatctaataaagtgttcaaaggtgatgacaaatggatcgacttgccaatatctaaaatagaggaggaatcccacgacaccagaaggtttacttttaagctgcctaccgaagactcagaaatggggttggtcctagcatctgctctgtttgctaaatttgtcacaccaaagggatccaatgtggtgagaccatacactcctgtgagtgatctttcccagaagggtcacttccagctggtcgtcaagcattatgaaggtggtaaaatgacctcacatttatttggtcttaaaccaaatgacaccgtttctttcaagggtcctattatgaaatggaagtggcaacctaatcagttcaagtcaatcaccttgttaggtgccggtaccggtatcaaccctctgtaccaattagctcatcatatagttgaaaacccaaacgacaagaccaaagttaacttgctatatgggaacaagactcctcaggacattttactaaggaaggaactggatgcgttgaaggaaaagtatcctgacaagttcaatgttacttactttgttgacgacaagcaagatgaccaagactttgatggtgaaattagtttcatctccaaagattttattcaggagcatgttccaggtccaaaggaaagcacacatttgtttgtctgcggtcccccaccatttatgaacgcttactcaggtgagaagaagtcacctaaggaccaaggtgaattgatcggtatcttgaacaatttgggctactccaaggaccaagttttcaaattttaa

SEQ ID NO: 250 - protein, 302 aa, Saccharomyces cerevisiae
MFSRLSRSHSKALPIALGTVAIAAATAFYFANRNQHSFVFNESNKVFKGDDKWIDLPISKIEEESHDTRRFTFKLPTEDSEMGLVLASALFAKFVTPKGSNVVRPYTPVSDLSQKGHFQLVVKHYEGGKMTSHLFGLKPNDTVSFKGPIMKWKWQPNQFKSITLLGAGTGINPLYQLAHHIVENPNDKTKVNLLYGNKTPQDILLRKELDALKEKYPDKFNVTYFVDDKQDDQDFDGEISFISKDFIQEHVPGPKESTHLFVCGPPPFMNAYSGEKKSPKDQGELIGILNNLGYSKDQVFKF

SEQ ID NO: 251 - DNA, 1099 bp, Saccharomyces cerevisiae
cgaaaggtttcgatcaaagtttggctcaatcactggacactattacttcgaaagcgcagtggggttaacagagaccgtgatgtcgtcaacaagtatttgaaggaaaatggttactattaagaaaaaatctcttttctagccattttgcctttttatatagtcaagtatctatatgtgacaaatacttcttctaagcttggccttctgataggcttagcttgcagtggttgcaaacatacataaatcaacaaaaaagtacggcttaaaattttggtattcatttatttcaacccgtgcacactggaaataaatctgtacataacagcatattttgtttttgaaaaaatttctgtgttcctccgatgtgggaagaattttaggatcggctaaatttcgtaaagtatcagtaacttggtatctctgtataagcggagtctaatttcgataacaagcaacttcatcgtaacaccttccaacaaagcaaagatagatatcccaaaatggtatgttagtatccaataaatgcagcgcaactggaccagtgaatagaacaatacatatagataagtcgcaaaagaaaagaatacatgtggtggaaaattttgcaccaagagaggcaagaactatgaagaaagacttttgaaatatttcaagcggttgctacatatagtggataagattcaggatggacgtatgagcttacagttcattgtaggggaatataaaattctgatgatggcgaacttcattcccagcaactcaagctattgttatttttctattctgcaccgagatgaggagaaaaaaggaagtttactaacagttagatttatttcttattcgtctacaacaggttttagttcaagatttattgcacccaactgcagcttctgaagcaagaaagcacaaattaaagacattagtccaaggtccaagatcgtacttcctagacgttaagtgcccaggttgtttgaacatcactacagttttctcacacgcccaaactgcagttacctgcgaatcctgctcaacaattttgtgcaccccaactggtggtaaggcaaagctttctgagggtacatctttcagaagaaagtaa

SEQ ID NO: 252 - protein, 82 aa, Saccharomyces cerevisiae
MVLVQDLLHPTAASEARKHKLKTLVQGPRSYFLDVKCPGCLNITTVFSHAQTAVTCESCSTILCTPTGGKAKLSEGTSFRRK

SEQ ID NO: 253 - DNA, 1103 bp, Saccharomyces cerevisiae
aaagaggcttcctattaggagcaataaaatataaagcaccagccatagaaagaatccccattataaagcccgctgttttttcctgattggagttcctaccgaactgaggggaggacgccatgagacgtcttgtttggtgtcggcataacccccttgccacttgaattgacggcctgtttctgcacgcattcctgacgactaagttgcgaagcattttactgataatatacactctttggatcgagcctacttccagttggtaattggtgttccacaatttcagcattatatgtttttaaaccaaaattcggctccttttccctttttttcttattgggtggcgtgccgtacagaacgattggcttggtgtgaaatcaagagcaagcacaatagatatcaacatgaacaatatacaaaagtctctggcacagtttgactgcgttagaccaggctagggcatttctgaagctttacgtatcactagagaagttattttggcaatgagaatctactacatcggtgtatttcgctctggaggagaaaaggctctagagttgagtgaagttaaagacttgtcacaatttggtttctttgaaaggtctagtgttggccagtttatgactttttttgctgaaacggtcgcttctagaactggtgcaggacaaagacaaagtatagaagaaggcaactatattggccacgtttatgccaggagtgagggcatatgtggtgttttgatcaccgacaaagaatatcctgtcagaccagcatacacactattaaacaaaatattggatgaatatttagtcgcacatcctaaggaagagtgggcagatgtgactgagaccaatgatgcattgaaaatgaagcaactggacacttacattagcaaatatcaagatccttcacaggctgacgctatcatgaaagttcaacaagaactggatgagacgaaaatcgttttgcacaaaacgattgagaatgttttacaaagaggtgaaaagttggataatttggtggacaaatcggagtcattaacggcaagttccaaaatgttttataagcaagctaaaaaatccaattcgtgttgcatcatcatgtag

SEQ ID NO: 254 - protein, 200 aa, Saccharomyces cerevisiae
MRIYYIGVFRSGGEKALELSEVKDLSQFGFFERSSVGQFMTFFAETVASRTGAGQRQSIEEGNYIGHVYARSEGICGVLITDKEYPVRPAYTLLNKILDEYLVAHPKEEWADVTETNDALKMKQLDTYISKYQDPSQADAIMKVQQELDETKIVLHKTIENVLQRGEKLDNLVDKSESLTASSKMFYKQAKKSNSCCIIM

SEQ ID NO: 255 - DNA, 1004 bp, Saccharomyces cerevisiae
gggcttttccagtgccgcggcctcgagatccaggcaccaggaactaggcacgctgtgtattctaacacattgaagggcctaggcccgctgacgtggggtctagttccactttttcattaccttttctcggtcttttcttgctcccacaggccgttaatggcctgaaacagttttgtgactttggacttatgataacgatgtttgtccgggtgccaccggattctatcgcggcgaatcaagtctagtctgtttgcatccatcaaggcactgctcattgtgtaaaattgttctacgcttttgtcatcaatcatatctaaactcacagccgctagggtaggtgtgcctggcagtggtaaggtagccggctcgtctttggtcatgcgccaatactgtcgaacggcccgcgcgtagcgttcttcggcttcaaccttagagctgataccttttgcctggtcaaaggcgaaaacgtctacctcgctttcactgctgctttcgctttcatgacttcgtttcaagcggtctctttcgctctcggttgtaacacacttgtagcctgctatgctttcaccgtactcgaaaagcgtagcctcatgactagttgtaccaacgccctttcttttcttttttttctcttgacacttcggcgtattcatcgccactggtacaagccgtatggtgcttttttgctcattttcgttttgacgttgcgatggtttcgcggaccaatcgcatgggtggtggtggatgttgtctttgctagttgcaacgtagtcttcttctctcctgcgctttctgacgaaaattggccttacgtatcttttttcggcgtcgttgtcgtcatcgctgttcatataatcgtcgtcactcatatcggcgcttttactgcatgctgtcttttgaagagagtttcattgaaaagtagtgaagaaaaaaaaaaaaaaaaaaaaaaaaaaaaggaaaaaagcttacatacggaaagagaaaaaaaaaaaaagaaattttaa

SEQ ID NO: 256 - protein, 167 aa, Saccharomyces cerevisiae
MTSFQAVSFALGCNTLVACYAFTVLEKRSLMTSCTNALSFLFFLLTLRRIHRHWYKPYGAFLLIFVLTLRWFRGPIAWVVVDVVFASCNVVFFSPALSDENWPYVSFFGVVVVIAVHIIVVTHIGAFTACCLLKRVSLKSSEEKKKKKKKKKEKSLHTEREKKKKKF

SEQ ID NO: 257 - DNA, 1424 bp, Saccharomyces cerevisiae
ttcaacagaaatgccgtagccggaaaaaccgaaagcgggggacagtgaagcgtgagaggggcgagacagggggaacttgaatggggtattttgcttttgctgcattttttccgctggtacctctatctttaggcgaccggaaaaattcattttctcatctttttttttttttcgtttccgactcgatactctttacaaagaaacccccgcggggaaatgttagatttgagctttttccgccaggaaaagaaaaaacctggggacattaatcttgttttttctttcttcttttgtcttcccttggatgactgcagaaaaagtacagttaccgggtcttagcaaaaacaaacatatatatatatatatatgaaagcgtatggtcaacacggttttataggttttactttttgcattcagttcaactttggccctttctcttatcgcattcagatactacacacaagtgttcatacacacacaaatagatacatatacagaaaatgactagtttggacgatacaataatttcgtaccagaatataatgttactggataacatgaccaactacaacaagcctgcgattgactatttccatcatgaatttaatgatgcaagcttggaaatatcggcttcatggacactactattgaagatgcgcaaacataaactacttcgattaccaagttgctcttcagaggacgtgctagattacaacatgtacctcgttaggctacatcattgcctctggaggcgttggtccataaatcactatggtttacagaactccaaatccaatccactgtccatcaactggaacaaagaaaccgatgtaacggtgttgtacggtccagatttgactaacatagatagtaatgaaaacgaaatatcgccggtccagaaccaaattgaccagaaacaaacaaaaaatctaaaatctgctttaaagaaaaatacggaatgctgggtaaccgaggaggtggatgagattaacgcttctatagagagcaatgacaacgctttggtgaaattagaagacatttcatgcccatcgtctgttgattctcacacgtcttccattttcgaccagcattctacatgcactaaaatttcctccatagatgaagattctgaagaccttatgaacgaaaagaaggaacaattccccaggaagttgaagtttaaccaagccgtgatgaagagggagatcgactcaaaggggactatccgcgaatccctcatcaacataaacgatatccaacattcccgccaccatcgccgtcaccatcgtcgccatcatcaccatcaccatcaaaatagttctcattctgatgaaacaataaaagaagctcattatgagttcagcaactatacatttggcactatggaagaagacattttttataggaaccaggttgttttttaa

SEQ ID NO: 258 - protein, 307 aa, Saccharomyces cerevisiae
MTSLDDTIISYQNIMLLDNMTNYNKPAIDYFHHEFNDASLEISASWTLLLKMRKHKLLRLPSCSSEDVLDYNMYLVRLHHCLWRRWSINHYGLQNSKSNPLSINWNKETDVTVLYGPDLTNIDSNENEISPVQNQIDQKQTKNLKSALKKNTECWVTEEVDEINASIESNDNALVKLEDISCPSSVDSHTSSIFDQHSTCTKISSIDEDSEDLMNEKKEQFPRKLKFNQAVMKREIDSKGTIRESLININDIQHSRHHRRHHRRHHHHHHQNSSHSDETIKEAHYEFSNYTFGTMEEDIFYRNQVVF

SEQ ID NO: 259 - DNA, 1613 bp, Saccharomyces cerevisiae
taaatagttgaggcttttcctgcattctgtcaagaagggtatgtgtatgaacatgcaaatgacactgtaaaatgattcattaccctgattatggagtgattttctttcctttttttttttacatttagtttcattattatgcaaattagagggtatacagttgagattttaacactttgaattaaaaagtgttacagaggaaaccgacgcaaaaggcttggtgacgcaaacttttccatctttatttcacctcttcagacggtcctaagaccttttgaacgtatcaatatagttttatcatctgttctctgttgttctccgttactaagatattagtcagctcttgaaatttcacacccctatttatttgtcttagcgtccaacccctctcaacccttttccatttcttgtataaaggtagttaattaggtaacgctgctcttaccatcactacagtgcttacgagaatttacccaaaccctgcgcaagataaataagaaatgtcgaaacagtgggcgagtggtacaaacggagctttcaaaagacaggtttcgtccttcagagaaacaatctctaagcaacacccaatttataagccagcaaagggaagatattggttgtatgtttcacttgcatgcccatgggcccatagaacactaattacgagggctttgaagggattaacctctgttataggatgtagcgtagtccattggcaccttgacgagaaaggatggagatttttggacatggaaaagcaattggaggacagtgaagattttttggaacattggcacgatgttgcaggtggtattagaactgctaaagaggattccagcaagagcttcgccgagatcaagaatgacagtcaaagattcatggttgatgctaccaatgagcctcactatggatacaagagaatcagtgacttatattacaagagcgatcctcaatactcggcaaggttcaccgtcccagtcctgtgggacttagaaacccaaacaattgttaacaacgaaagtagcgaaattataaggattttgaactctagtgcgttcgatgaatttgtcgacgacgatcacaagaaaacggaccttgttcctgctcagttgaaaacacagatcgatgacttcaattcttgggtttacgacagcatcaacaatggtgtatacaagaccggattcgcagagaaagcagaagtttacgaaagtgaagtcaacaacgtatttgaacatttggacaaagtggagaaaatcctgagtgacaaatattccaaattgaaggccaaatacggtgaagaagatagacaaaaaatcttgggtgagttcttcactgtgggtgatcaattaacagaagctgacattagattgtatactaccgtcataagattcgatcctgtgtacgtccaacatttcaaatgcaattttacctctattagagccggatatccatttattcatttgtgggtaagaaatttatactggaattatgatgccttcaggtacacaacagattttgaccatatcaagttacactacacgcgttcccacacaaggatcaaccccttgggaattacgcccctgggacccaagccagatattcgtcctttataa

SEQ ID NO: 260 - protein, 370 aa, Saccharomyces cerevisiae
MSKQWASGTNGAFKRQVSSFRETISKQHPIYKPAKGRYWLYVSLACPWAHRTLITRALKGLTSVIGCSVVHWHLDEKGWRFLDMEKQLEDSEDFLEHWHDVAGGIRTAKEDSSKSFAEIKNDSQRFMVDATNEPHYGYKRISDLYYKSDPQYSARFTVPVLWDLETQTIVNNESSEIIRILNSSAFDEFVDDDHKKTDLVPAQLKTQIDDFNSWVYDSINNGVYKTGFAEKAEVYESEVNNVFEHLDKVEKILSDKYSKLKAKYGEEDRQKILGEFFTVGDQLTEADIRLYTTVIRFDPVYVQHFKCNFTSIRAGYPFIHLWVRNLYWNYDAFRYTTDFDHIKLHYTRSHTRINPLGITPLGPKPDIRPL

SEQ ID NO: 261 - DNA, 1721 bp, Saccharomyces cerevisiae
tcaaggatacctggttgattctacgtcgtcctcttcactttggttaattcacctttgcccttcaccttgtggtgtgcgggtgttgcagtcattaatgttctttatcgcgagagggggtctacataatcttgttttttcactccaataaggcagttatagtgaatttgttttattacagaaggtgtacccttcgttcgagttattttactcttgttttgtagtttgtacatctctttatgtctggatcaaaacgataattcgaagcttattgcaatttagttctcttacccatttctttacaacgggccgagaaaaagtggagttggtccgaggaagctttgaacgggaagaggaaaaaaccttcccatcgctcgagcatacaattttttttttttcaatgcaggctgaaaaaaaaaaattcacttgatgattgaactcatcgcacttttatacaaagcaagaaagaaacccaagtcgcagtacactaagaatacatagcaatggcttccaagaaaattaaagttgacgaagtgccaaaattaagtgttaaggagaaggagattgaagagaaatcttcttcttcttcttcctcctcctcctcctcctcctcctcctcttcttcttcatcttcctcgtccagttctagcggcgaatcttcaagcagcagcagcagcagcagcagcagcagcagcagtgacagcagtgacagcagtgactctgaatctagctcatcatcatcttcttcttctagctcaagctcaagttccagtgactctgaatcttctagtgaatccgactctagctccagtggatcttcttcttcctctagctctagttctgacgaatcttcttcggaatccgaatcagaagatgaaaccaagaaaagagcaagagaatcagacaacgaagatgctaaggagactaaaaaggctaaaactgaaccagaaagctcttcctcatcggagtcaagctctagcgggtcatcgtcatcttcagaatcagaatcaggttcggaatctgattctgactcaagttctagctcaagtagttcttctgattccgaatcagattctgaatcagattctcaatcaagttctagctccagctctagcgactcttcgtctgactccgactccagctccagcgactcttcatctgactccgactctagctccagctctagcagctcttcctcggattcagattcggattccgactcaagctcggactcagactcttcaggctcgtccgattcttcaagctcgtctgattcaagttccgacgaatctacatcttctgattcctccgattcggattccgactcagactctggttctagctctgaattggaaacaaaagaagcaactgcagacgaatccaaggccgaagaaacgcctgcctcatctaacgaatcaactccatctgcttccagttcatcaagcgccaataaattgaacattcctgctggaaccgacgagatcaaagagggccaaagaaagcatttttccagagtagatagatcgaagattaatttcgaagcttgggagttgacagacaacacctacaaaggcgcggctggaacatggggtgaaaaggcaaatgaaaaattaggtagagtaagaggtaaagatttcacgaagaacaaaaataaaatgaagagaggttcttacagaggtggatccattacattagaaagtggttcatacaaattccaagattaa

SEQ ID NO: 262 - protein, 406 aa, Saccharomyces cerevisiae
MASKKIKVDEVPKLSVKEKEIEEKSSSSSSSSSSSSSSSSSSSSSSSSSGESSSSSSSSSSSSSSDSSDSSDSESSSSSSSSSSSSSSSSDSESSSESDSSSSGSSSSSSSSSDESSSESESEDETKKRARESDNEDAKETKKAKTEPESSSSSESSSSGSSSSSESESGSESDSDSSSSSSSSSDSESDSESDSQSSSSSSSSDSSSDSDSSSSDSSSDSDSSSSSSSSSSDSDSDSDSSSDSDSSGSSDSSSSSDSSSDESTSSDSSDSDSDSDSGSSSELETKEATADESKAEETPASSNESTPSASSSSSANKLNIPAGTDEIKEGQRKHFSRVDRSKINFEAWELTDNTYKGAAGTWGEKANEKLGRVRGKDFTKNKNKMKRGSYRGGSITLESGSYKFQD

SEQ ID NO: 263 - DNA, 2150 bp, Saccharomyces cerevisiae
ataggaaaaaaccgagcttcctttcatccggcgcggctgtgttctacatatcactgaagctccgggtattttaagttatacaagggaaagatgccggctagactagcaagttttaggctgcttaacattatggataggcggataaagggcccaaacaggattgtaaagcttagacgcttctggttggacaatggtacgtttgtgtattaagtaaggcttggctggggatagcaacattgggcagagtatagaagaccacaaaaaaaaggtatataagggcagagaagtctttgtaatgtgtgtaacttctcttccatgtgtaatcagtatttctacttacttcttaaatatacagaagtaagacagataaccaacagcctttcccagatatacatatatatctttatttcagcttaaacaataattatatttgtttaactcaaaaataaaaaaaaaaaaccaaactcacgcaactaattattccataataaaataacaacatgtccccttctaaaatgaatgctacagtaggatctacttccgaagttgaacaaaaaatcagacaagaattggctcttagtgacgaagtcaccaccatcagacgcaatgctccagctgccgttttgtatgaagatggtctaaaagaaaataaaactgtcatttcatcaagcggtgcattgatcgcttattccggtgttaaaaccggaagatctccaaaggacaaacgtattgttgaagaacctacctcgaaagacgaaatttggtggggtccggtcaataaaccatgttctgaaagaacatggtctatcaaccgtgaaagagctgcagattacttgagaacaagagaccacatttatattgtcgatgcatttgcaggatgggatccaaaatacagaatcaaagtccgcgttgtttgtgccagggcttaccacgctttattcatgacaaatatgcttattagacctacagaagaagaattagcccattttggagaacctgattttactgtctggaacgctggtcagttcccagccaatttacacacccaggatatgtcttcaaagagtactatagaaattaacttcaaagcaatggaaatgatcattttaggtaccgaatacgccggtgaaatgaaaaaaggtattttcacagttatgttttacttgatgcctgtgcaccataacgttttaactttgcactcttccgccaaccagggtattcaaaacggtgacgttactttattctttggcctaagtggtaccgggaaaaccactttatccgcagacccacatagattgttgatcggcgatgatgaacattgttggtccgaccatggtgtcttcaatatcgaaggtggttgttacgccaagtgtattaatttatctgccgaaaaggagcctgaaattttcgacgctatcaagtttggttctgtattagaaaacgttatctatgacgagaagtcgcatgtagtcgactatgacgactcttctattactgaaaatactagatgtgcctacccaattgactacattccaagtgccaagattccatgtttggcggactctcatccaaagaacattatcctgctaacttgtgatgcttcgggtgttttaccaccagtatctaaattgactcctgaacaagtcatgtaccatttcatctctggttacacttctaaaatggctggtactgagcaaggtgtcactgaacctgaaccaacattttcatcttgtttcggacaacccttcctagccttgcaccctattagatacgcaaccatgttagctacaaagatgtctcaacataaagctaatgcgtacttaatcaacaccggctggactggttcttcctacgtatctggtggtaaacgttgcccattgaagtacacaagggccattctggattctattcatgatggttcgttagccaatgaaacgtacgaaactttaccgattttcaatcttcaagtacctaccaaggttaacggtgttccagctgagcttttgaatcctgctaaaaactggtctcaaggtgaatccaaatacagaggtgcagttaccaacttggccaacttgtttgttcaaaatttcaagatttatcaagacagagccacaccagatgtattagccgctggtcctcaattcgagtaa

SEQ ID NO: 264 - protein, 549 aa, Saccharomyces cerevisiae
MSPSKMNATVGSTSEVEQKIRQELALSDEVTTIRRNAPAAVLYEDGLKENKTVISSSGALIAYSGVKTGRSPKDKRIVEEPTSKDEIWWGPVNKPCSERTWSINRERAADYLRTRDHIYIVDAFAGWDPKYRIKVRVVCARAYHALFMTNMLIRPTEEELAHFGEPDFTVWNAGQFPANLHTQDMSSKSTIEINFKAMEMIILGTEYAGEMKKGIFTVMFYLMPVHHNVLTLHSSANQGIQNGDVTLFFGLSGTGKTTLSADPHRLLIGDDEHCWSDHGVFNIEGGCYAKCINLSAEKEPEIFDAIKFGSVLENVIYDEKSHVVDYDDSSITENTRCAYPIDYIPSAKIPCLADSHPKNIILLTCDASGVLPPVSKLTPEQVMYHFISGYTSKMAGTEQGVTEPEPTFSSCFGQPFLALHPIRYATMLATKMSQHKANAYLINTGWTGSSYVSGGKRCPLKYTRAILDSIHDGSLANETYETLPIFNLQVPTKVNGVPAELLNPAKNWSQGESKYRGAVTNLANLFVQNFKIYQDRATPDVLAAGPQFE

SEQ ID NO: 265 - DNA, 1115 bp, Saccharomyces cerevisiae
tcgacacttacttaatatgttttgccgcccttcataagagggtgtttctaaaatttattgggcaagaatgagatggactcgcaccctacatgacgtttaaatatttagtgttaaggttcagaacatgcaccaggtgcgacatgtgttgcgattatcatgacaatgtctctatccgagatgcatttgtagtatcaattgatgcgtattatgacatgatttacatagcatacatcgtcaaacatgatattatattctttttttgataaatgtacggatttaaagctgtcgaatatattttctgaaatttcttggagctgacgcaaaattttcaaaggtgctaaaatttttcaagatttctcacttttgcttggtaacaaagaatgatggcattgcatttttaccaccggtacatttaactgctatttctcacgtttctttccctatccttaagtaattcttttacaatctaagaaaaccacgatcaaacaaataaatcagcaatgggtgcctacaaatatttggaagaattgcaaagaaagaagcaatctgatgttttgagattcttgcaaagagtcagagtctgggaatacagacaaaagaatgtcattcacagagccgctagaccaactagaccagacaaggctagaagattgggttacaaagctaagcaaggtttcgttatctaccgtgtcagagttagacgtggtaacagaaagagacctgttccaaagggtgctacttacggtaagccaactaaccaaggtgtcaatgaattgaaataccaaagatccttgagagctaccgctgaagaaagagttggtcgtcgtgccgctaacttgagagtcttgaactcctactgggttaaccaagattctacttacaagtacttcgaagttatcttggtcgaccctcaacacaaggctatcagaagagatgctcgttacaactggatctgtgacccagttcacaagcaccgtgaagctagaggtttgactgccactggtaagaaatccagaggtatcaacaagggtcacaaattcaacaacaccaaggctggtagaagaaagacctggaagagacaaaacactttgtccttgtggagatacagaaaataa

SEQ ID NO: 266 - protein, 204 aa, Saccharomyces cerevisiae
MGAYKYLEELQRKKQSDVLRFLQRVRVWEYRQKNVIHRAARPTRPDKARRLGYKAKQGFVIYRVRVRRGNRKRPVPKGATYGKPTNQGVNELKYQRSLRATAEERVGRRAANLRVLNSYWVNQDSTYKYFEVILVDPQHKAIRRDARYNWICDPVHKHREARGLTATGKKSRGINKGHKFNNTKAGRRKTWKRQNTLSLWRYRK

SEQ ID NO: 267 - DNA, 752 bp, Saccharomyces cerevisiae
ggaaagcaaagctctaaatgataactctacaaaaaagtcagagaaatctgtcactaatttattgaaggatgaagaattaatgcttaaagtcttagagcttttggtgacaagtgctgcaaacgccacagacccaattaaagctaccgattcgtgggacatgtgtttccaattaatacgcttactcaaggaattagacagagaaaacaacacacaattggttcaaaaagcactcgagagattcaaataaatctatatgacaccatgtattctttaccatatagcttcataacattgaccaatcaattttcagaaatgcgtcgcgcgtagttttgcccgatatccccatcccttcaggatctttaaaaggtgatgaaagatgcaccagatagaaaagttgcattaaaatgattagcagagatatacaaatattttagtaagaatacataaagtatctttgctttcacaaataggaacaagcacataaatacagtataatagacatggctgatcaagaaaactctccactacatacagttggtttcgatgctagatttccccaacaaaaccaaacaaagcattgttggcaatcttatgtggattatcacaagtgtgttaatatgaagggcgaagattttgctccgtgcaaggtcttttggaagacctataacgccttatgtcccctagactggatcgaaaaatgggatgatcaaagagaaaaaggtattttcgcaggtgatatcaactcagactaa

SEQ ID NO: 268 - protein, 83 aa, Saccharomyces cerevisiae
MADQENSPLHTVGFDARFPQQNQTKHCWQSYVDYHKCVNMKGEDFAPCKVFWKTYNALCPLDWIEKWDDQREKGIFAGDINSD

SEQ ID NO: 269 - DNA, 812 bp, Saccharomyces cerevisiae
agacaagtctttcaacgacaactctaagatcagaatgattgaaatcatgttgccagtcttcgatgctccacaaaacttggttgaacaagctaagttgactgctgctaccaacgctaagcaataagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaattctctgaacaatacccacaagctgatttctataaattggatgtcgatgaattgggtgatgttgcacaaaagaatgaagtttccgctatgccaactttgcttctattcaagaacggtaaggaagttgcaaaggttgttggtgccaacccagcggctattaagcaagccattgctgctaatgcttaa

SEQ ID NO: 270 - protein, 103 aa, Saccharomyces cerevisiae
MVTQFKTASEFDSAIAQDKLVVVDFYATWCGPCKMIAPMIEKFSEQYPQADFYKLDVDELGDVAQKNEVSAMPTLLLFKNGKEVAKVVGANPAAIKQAIAANA

SEQ ID NO: 271 - DNA, 827 bp, Saccharomyces cerevisiae
aacactggggatattttgagatttaccactagtagatacggtggtgtagatacgtatgattccatcttgagggaccaatccacgatcatggaacttttagataaacggtgtgcctattcacctccagtactgttcgataatgaggctaaagaacgtgatcatgatcgcgattgttatcaagattacaatcacgaccaccggagtcattaatattaaaaaaaaaaaatgtgattgttaataaggggtgggatgcgcgaaattctatgcctacagtagaaagcggttgttgcacaaatgattaaatctttatctccaactcacaatactatcgcgatagatgcataatatgtgcagcttctaaacagcacggagtgatgataaatacgcatatatgtatatatatatgtatgtgcatatgcacgtccttttaaaactcaaaatacaacattcttagtaaatccttttgttgacacacgtcggaacaactcaggacggagttaatggatatgcttcataataaatgtagtgatgctatcaaaagcacctccaatagcaatttgagtaatgaggtagacaaacaaaaattgcaatacgatgacctcgggaacaccggattttctgaactatttgagatggaatctcaagataataatgatagcatagaggatttcttgttctttaatataaatttaacccaggaggttgagttcgagaaccaaagacaatatgagcacacgaaaaagacaaagaagcataacccattctatgtaccgtcagaggtagtgcgagagatggtcaagaaacacgcattgaatggcagaatatag

SEQ ID NO: 272 - protein, 108 aa, Saccharomyces cerevisiae
MDMLHNKCSDAIKSTSNSNLSNEVDKQKLQYDDLGNTGFSELFEMESQDNNDSIEDFLFFNINLTQEVEFENQRQYEHTKKTKKHNPFYVPSEVVREMVKKHALNGRI

SEQ ID NO: 273 - DNA, 1031 bp, Saccharomyces cerevisiae
tgtctattagtaatcaagaaaagaaccctaaatcatcggcgtcccctgtggggctctcggaaaaaccggtcctgacgtcactgaaaagatttcggcacatggtcatgggaccagagaaaaattaatccgacatgtggaatatttccttccgttaaggtagtgagcgcggattttttctgatttgtaattatacggggagctctggccaaaaaggtcagtatttggtgatgaagttgaatatcatcttttgattttcttctgtatcattctttttctttttccacaccccttccggacggtattcacatattgttgagaggttaaatgaaaaataaaggggtggaaaattaaggacgagatgtaagggaaaagcataaacgaaacattatataaaggagcacaatttcctctcccttgccaattgtgcatataccgtttctttataacgaaatttcaacaaaccagaacaacacaagtactaccaataaccacaacaaaacatgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtag

SEQ ID NO: 274 - protein, 176 aa, Saccharomyces cerevisiae
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 275 - DNA, 902 bp, Saccharomyces cerevisiae
tattggcgtctgatttccgttttgggaatcctttgccgcgcgcccctctcaaaactccgcacaagtcccagaaagcgggaaagaaataaaacgccaccaaaaaaaaaaaaataaaagccaatcctcgaagcgtgggtggtaggccctggattatcccgtacaagtatttctcaggagtaaaaaaaccgtttgttttggaattccccatttcgcggccacctacgccgctatctttgcaacaactatctgcgataactcagcaaattttgcatattcgtgttgcagtattgcgataatgggagtcttacttccaacataacggcagaaagaaatgtgagaaaattttgcatcctttgcctccgttcaagtatataaagtcggcatgcttgataatctttctttccatcctacattgttctaattattcttattctcctttattctttcctaacataccaagaaattaatcttctgtcattcgcttaaacactatatcaataatgcaattttctactgtcgcttctatcgccgctgtcgccgctgtcgcttctgccgctgctaacgttaccactgctactgtcagccaagaatctaccactttggtcaccatcacttcttgtgaagaccacgtctgttctgaaactgtctccccagctttggtttccaccgctaccgtcaccgtcgatgacgttatcactcaatacaccacctggtgcccattgaccactgaagccccaaagaacggtacttctactgctgctccagttacctctactgaagctccaaagaacaccacctctgctgctccaactcactctgtcacctcttacactggtgctgctgctaaggctttgccagctgctggtgctttgttggctggtgccgctgctttgttgttgtaa

SEQ ID NO: 276 - protein, 133 aa, Saccharomyces cerevisiae
MQFSTVASIAAVAAVASAAANVTTATVSQESTTLVTITSCEDHVCSETVSPALVSTATVTVDDVITQYTTWCPLTTEAPKNGTSTAAPVTSTEAPKNTTSAAPTHSVTSYTGAAAKALPAAGALLAGAAALLL

SEQ ID NO: 277 - DNA, 2342 bp, Saccharomyces cerevisiae
tacaccctgactttccccatcatacgacgatgctctagtaaacttgcacccgcacctgttagataaacaagtgcgcccaagatcacaataccgaaggggcgatatcaccactcagtattctacagtcgagcatagcgtagtctggcagtatcccgcacgatccattgtattgtttgtccaaaccgcattttatgtgtaacgattaatcgtatatacatggcctacaagaaattaccctgcggcgaagggtgaaaaaaaaagtagtggaaactaaagaaagaagagtttagttacggaccctttcaaggattgacacactcccaatattttgctacattattgacctttgttgaaggaggcgttcgtttatttaattattttgttctgttttgcctacaactgcgaatacgctcacattctagtttgaccttcacaaattcttatcatcttcttttgtttattttgacacacccctattaagtgtatttgttttgtaagtaatgtctaagcagtttgttcgttctgcaaagaacatgatgaagggctactcatccacacaagtgcttgtgagagatgccacggcgaacgactcgaggactccatcgatagacactctcgacgatttggcacagagatcttacgattcggtggacttcttcgagattatggatatgttagacaagaggctgaacgataagggcaaatactggagacacgttgccaaatcgctgaccgttttggactatcttgttcgtttcgggagtgagaactgtgtgctatggtgcagagagaatttttacgtaattaagacattaagggaattcagacacgaaaatgagtccggatttgacgagggacaaattatcagagtaaaggctaaagaactcgtctctttgttgaatgatgaagaaaggctacgcgaagagaggtctatgaatacaagaaacagaagggcgaacagagctgctaggccaaggccaagaagacaaagaacaaggagcaacccacacgattcttctccctcttaccaggacgatttggaaaaggccctagaggagagcagaattactgctcaagaagatgaacaacgtagaagagaactggcccagtacgacgatgaagatcctgacttccaagctgccttacaactaagtaaagaagaagaggagttgaagcaattgcaggaactacagagattacagaagcaacaacagtctctgtctcaatttcaagctcctttacaacaacaacaaccacaacaacaaccagcgtactacgacattttcggtaatccaatctcccaagatgaatacttacagtatcagtaccaacaggaccaggaacaagcaatggctcagcaaagatggctggaccagcagcaagaacaacagcagcttgctgaacaacaatattttcagcagcaacaacaagctgcggccgccgcttctgccttgcaacagcaacaaacagccgctaatatgcaacaacaacaacaacagcccgctgattttcaacaacctttgcctacaggttctaataatccgttttccatggataatcttgaaagacaaaagcaggagcaacagcatgctcaattgcaaagacaacaagaagaagctagacaacaacaagaacaattgaagctacaacaattgcaaagacaacaacaagaggaagctcaattacaccagaagaggcaagaagaagcccaattacaacagcagcaagcccaattgctacaacagcaagcccagttccagcaacaacaacccttgaagcaaacaaggactgggaaccagtctatatcggataaatacagcgacttgaataccttgttagcaactggtacagggatagatacttttggtaacactggagaggcacgtattcctgcacaacatacaaagacaggcacatttataaattctcagggtacaggctacaaacaggttactaatgaacccaagaacaaccctttcttaagcaaccaatacactggtttaccaagcacaaatatcgtgcccacgcaaacagggtacgggtttggtaaccaacctcaaagtcctcctactaattctcctcagcaaaatcctactggtataagctactctcagccacaacagcaacaacagccacagcaacaaccgcaatacatgcaaaatttccaacaacagcaacctcaatacgcccaaaacttccaacaacaaccacaatacactcaaaattatcaacaacaaccacaatacattcaacctcatcaacaacaacagcagcagcagcagcagcaacagcagcaacagggatatactcctgaccaaggtgtaagcttaattgatctttga

SEQ ID NO: 278 - protein, 613 aa, Saccharomyces cerevisiae
MSKQFVRSAKNMMKGYSSTQVLVRDATANDSRTPSIDTLDDLAQRSYDSVDFFEIMDMLDKRLNDKGKYWRHVAKSLTVLDYLVRFGSENCVLWCRENFYVIKTLREFRHENESGFDEGQIIRVKAKELVSLLNDEERLREERSMNTRNRRANRAARPRPRRQRTRSNPHDSSPSYQDDLEKALEESRITAQEDEQRRRELAQYDDEDPDFQAALQLSKEEEELKQLQELQRLQKQQQSLSQFQAPLQQQQPQQQPAYYDIFGNPISQDEYLQYQYQQDQEQAMAQQRWLDQQQEQQQLAEQQYFQQQQQAAAAASALQQQQTAANMQQQQQQPADFQQPLPTGSNNPFSMDNLERQKQEQQHAQLQRQQEEARQQQEQLKLQQLQRQQQEEAQLHQKRQEEAQLQQQQAQLLQQQAQFQQQQPLKQTRTGNQSISDKYSDLNTLLATGTGIDTFGNTGEARIPAQHTKTGTFINSQGTGYKQVTNEPKNNPFLSNQYTGLPSTNIVPTQTGYGFGNQPQSPPTNSPQQNPTGISYSQPQQQQQPQQQPQYMQNFQQQQPQYAQNFQQQPQYTQNYQQQPQYIQPHQQQQQQQQQQQQQQGYTPDQGVSLIDL

SEQ ID NO: 279 - DNA, 1616 bp, Saccharomyces cerevisiae
gaagaatacaaagaggtccaagaagacgaagacccggatgtgtgggacacgagaatatccaagaccggatgctacgtagagaacctcgcattacagctgtgccatgccgaaacaggtgactggaggcagtgcttcaacgagatggcgttatttaggaagtgttgggaaaagaatggtaatagagagcgcgtaagcacagtggacgtggatgggacgaccagtaaggattcggaaaagaagaaatgaaaatctaaatgtcgtgatgtataacttgtatataatagacagctgcagtgatcgaaacacattgtttccctttatagaacataactgttacgcttttgaacggcatttctatgagcttctagaatatttttccgccctagctggagaaagttcagacagaaaattatttaaataagtcgaatatcagaggtgctgatgcgctcacatcacatagaaaactggtaagacaatattcaggcgatcaaggagtaaaaatgactagacctaaaactttttttgatatttctattggaggtaaaccccaaggccgtatagtttttgagttgtacaatgacatagtgcctaaaacggctgaaaattttttgaagttgtgtgaaggaaatgctggtatggcaaagactaaacctgatgtaccattgtcgtacaagggttccattttccacagagtgatcaaagacttcatgtgtcaatttggtgattttaccaattttaatggtactggcggtgagagcatatacgatgaaaaattcgaggatgaaaatttcactgttaaacatgataaaccattccttctatccatggccaacgccggtccaaataccaatggatctcaagctttcataacctgtgttcctacacctcatttggacgggaagcacgttgtgtttggtgaagtgattcaaggtaaaagaattgttcgtttgattgaaaaccaacaatgtgaccaagaaaacaacaagccattgcgtgatgtaaagattgatgactgtggcgtgttacctgacgattatcaagtgccagagaatgccgaagctacaccaacagatgagtacggcgataattatgaagatgttttaaaacaagacgaaaaagttgacttgaagaatttcgacaccgtcttgaaagctatcgaaacggtaaagaacattggtactgaacagttcaagaaacagaactattccgtggctttagaaaaatatgtcaaatgtgataaattcttgaaagagtatttcccagaagatttggagaaggaacaaattgaaaaaatcaatcaattgaaagtgtctattccattgaatattgccatctgtgctcttaaattaaaagattacaagcaagtattagtagcctcatcggaggtgttatatgccgaagcggctgacgaaaaagccaaggccaaagctttgtaccgtcgtggcctggcctattaccatgttaatgacacagatatggctctcaatgacctagaaatggccactactttccagccaaatgacgctgccattttgaaagctattcataatactaaattaaaaagaaagcaacaaaacgaaaaagctaaaaagtctctttcgaagatgttctcctga

SEQ ID NO: 280 - protein, 371 aa, Saccharomyces cerevisiae
MTRPKTFFDISIGGKPQGRIVFELYNDIVPKTAENFLKLCEGNAGMAKTKPDVPLSYKGSIFHRVIKDFMCQFGDFTNFNGTGGESIYDEKFEDENFTVKHDKPFLLSMANAGPNTNGSQAFITCVPTPHLDGKHVVFGEVIQGKRIVRLIENQQCDQENNKPLRDVKIDDCGVLPDDYQVPENAEATPTDEYGDNYEDVLKQDEKVDLKNFDTVLKAIETVKNIGTEQFKKQNYSVALEKYVKCDKFLKEYFPEDLEKEQIEKINQLKVSIPLNIAICALKLKDYKQVLVASSEVLYAEAADEKAKAKALYRRGLAYYHVNDTDMALNDLEMATTFQPNDAAILKAIHNTKLKRKQQNEKAKKSLSKMFS

SEQ ID NO: 281 - DNA, 830 bp, Saccharomyces cerevisiae
accaaccaacttcttcctttgtcctcaatatcaaagaaaaaaaaaaaaacccactgctcagatgttataaggaaggggtgttaacttatatacaggttcatctaccagtcaccagtccatacaaacttgaaccgtctgcgtaccagtcctaatcaaaatgttccctatcgcttccagaagaatactgctcaatgcttcagttctgccattgagactgtgcaatagaaatttcactaccacaagaatatcctacaacgtcatacaagatttgtatttgagggaactaaaagacaccaaactggctccaagtaccttgcaagatgctgaaggtaatgttaagccttggaacccaccacaaaaaccaaatctaccagaattggaacttcaaggcccagaggctttaaaggcttacaccgagcaaaatgtagaaactgctcatgttgctaaagagtctgaagagggtgagtcagagccaattgaagaggattggctagttttggatgatgctgaggaaaccaaagaaagtcattgaacttttcatagcatcctccttgtcgaagaaaaaacaaacagaaccacaagctgaacaagatcattatttttggctttcttcctctcatctttttatattcgaatccagtacaataaagaaaaagcaaaatacactacgcactctttgtaatcagccacacaaaatgcagaatttattttttaaacaaaaaatacaattgtacatagacacgtctttatctttcctattactactattcttttatttcaataactattactttctaagtatgacctacgcttctttggtaaataaataa

SEQ ID NO: 282 - protein, 109 aa, Saccharomyces cerevisiae
MMLRKPKKVIELFIASSLSKKKQTEPQAEQDHYFWLSSSHLFIFESSTIKKKQNTLRTLCNQPHKMQNLFFKQKIQLYIDTSLSFLLLLFFYFNNYYFLSMTYASLVNK

SEQ ID NO: 283 - DNA, 848 bp, Saccharomyces cerevisiae
acaaaacagacttagttattttatggtatacaacaaaagctcgaatgaaagacggttggcacaagagaattaacaaaataaacggaggaagaataaagttacacctatttctcaagaattcttttaaatccgctcaagaaagtttaagggtattgcataaagaacagaaacgccgctggaaaaggctctttgtgctacttcataataaatacaggcaattttctccacatattaaaaggtatttcgatcattcttgccaaaaagcaaaacaatgttggtcgggatccagattgcagttgcgcaagcttcgtttcaagtcaatgaaaccattccgagtttttcagtttaaggttcgcaaagataccaactggtttgtaaagcagctgaaacggttcggattgaaattacagcattcgaggatgtataaagcgatgtcagaatgcaggaaaaaaaattattttaagtgcaaacactagatcatccaaaacccagcatgaagaatgaaattaacaaaagaaaaaaaaaacgactgcttagtaggagtgtcatatatccctcctttaaatttttttacacttactttcctttttttattgagaatagaaaaggtgcatctctctctctctctctctctatctctatctctaaggttttattactttcataacgtatgctatccatctcttttcctttttttttgttttgttattccctttttttactcagttagattcatactactatatttacatattcttcgaagcttttatgagttaaatattttgttgctttatggggcagaaaatagtcgacgtcagtcacctccaggttattatgtaattcgctaa

SEQ ID NO: 284 - protein, 115 aa, Saccharomyces cerevisiae
MKLTKEKKNDCLVGVSYIPPLNFFTLTFLFLLRIEKVHLSLSLSLSLSLRFYYFHNVCYPSLFLFFCFVIPFFYSVRFILLYLHILRSFYELNILLLYGAENSRRQSPPGYYVIR

SEQ ID NO: 285 - DNA, 1697 bp, Saccharomyces cerevisiae
catcaattagggcaaacttgaatagtcagctaggtcatatatttaaaatcaattagccctatgactacattaggtttattgttaggtctttacggctgcatatttgctttcgccgttcggcggggtcctgcgacgatttctgcgcggtcttgtatgggtggagttgacagttaaccctccggaccccctaccccggtgtgcccccggtccatctatccattttgcggtaacccctttgcgcgacagctgcttatcaaggtacctggatcgagccataaaaattgatctacacagatgagatggggcattgggatatattattagtcggagtatcattatagttattcagttttatgcaggttactggccaaacgtttttcttcatttggaataatcgtttaggagctactgttccggtataaagtaacaagcacagtagcagagtaatacgcagtgacgataatagagactagtaaaacagtcgagttgtcggacctaaaatgtcagaagaagacgatcattggaatttagttagattacgtagattacgtaaagggagagaaggggaagaacagtcatcgaagtcagaaatatctttggatagtttgcatgaaagctcctttgcaggagaggacgacgaggacttcgatgcagatgtcctatcgaacactagcagtgaagagtctgcacagatgaatcgtatttacgattttagaacatctaatgaatttagtaatgctggagttaatattgatcaaactggagttcccactatttcagagtcatttgatactttgtccggctcaaatgttggcggaacggtattgccaagtatggaggggtcgaaactgaaggatagtacgataaggaattctagcacactatcggatcatatcatagataaaagtgagggtaaatctgctaaattgaagatgtggcatgttatcatgctatcttcattgctttccatgaccttttcatacctcgccctcgaatattccctgactggtgatgtgttggcaggttttaaatcacaacagtcattacgtaataatgaaaggaagctgttgtacggcaatatcgattttgttgataaaaaatcttacgattcatcaagtgactctttaagtcagtgggctccttcaggaaaatactacgtcgacttcgacaatcatattgcatacccattaaaggatgatgacctaatgggctggagacgatacaaaacagacttagttattttatggtatacaacaaaagctcgaatgaaagacggttggcacaagagaattaacaaaataaacggaggaagaataaagttacacctatttctcaagaattcttttaaatccgctcaagaaagtttaagggtattgcataaagaacagaaacgccgctggaaaaggctctttgtgctacttcataataaatacaggcaattttctccacatattaaaaggtatttcgatcattcttgccaaaaagcaaaacaatgttggtcgggatccagattgcagttgcgcaagcttcgtttcaagtcaatgaaaccattccgagtttttcagtttaaggttcgcaaagataccaactggtttgtaaagcagctgaaacggttcggattgaaattacagcattcgaggatgtataaagcgatgtcagaatgcaggaaaaaaaattattttaagtgcaaacactag

SEQ ID NO: 286 - protein, 398 aa, Saccharomyces cerevisiae
MSEEDDHWNLVRLRRLRKGREGEEQSSKSEISLDSLHESSFAGEDDEDFDADVLSNTSSEESAQMNRIYDFRTSNEFSNAGVNIDQTGVPTISESFDTLSGSNVGGTVLPSMEGSKLKDSTIRNSSTLSDHIIDKSEGKSAKLKMWHVIMLSSLLSMTFSYLALEYSLTGDVLAGFKSQQSLRNNERKLLYGNIDFVDKKSYDSSSDSLSQWAPSGKYYVDFDNHIAYPLKDDDLMGWRRYKTDLVILWYTTKARMKDGWHKRINKINGGRIKLHLFLKNSFKSAQESLRVLHKEQKRRWKRLFVLLHNKYRQFSPHIKRYFDHSCQKAKQCWSGSRLQLRKLRFKSMKPFRVFQFKVRKDTNWFVKQLKRFGLKLQHSRMYKAMSECRKKNYFKCKH

SEQ ID NO: 287 - DNA, 761 bp, Saccharomyces cerevisiae
ttctcatacgtatgtttttttagattatgcaccttctttgccacagtaaatgtggcggggaagatgttgagctagcgccgtgcacagtggaagagacggaggcgattgtggggtttcatcggattgtgcgggaagaaggcctacaccgtgttgagccacccccccctcaggagtaaatttacacaaacagtggtggtgcctatggtggtatacgagatagtgatagaagctgctggattggggtagaaattttgtaggcgtttatggatatggtatggatatggtatggcttgaggtaggtaatccagacaccactggaaatatatataaggagagagttctggcaggtagatttgtactcctctctaccactttcttctactccttttattatgtaatgtttattataagcacagcaaaaacgttaaataaatctaataagatttcattataacataacattaaagcacacaaatttctaacacaaacacaattcaaacatgaccagaactagcaaatggacagtccacgaagcaaagtctaacccaaagtatttcacccataacggcaactttggggagtctcccaaccacgtcaagagaggaggctatgggaaaggcaattggggcaagcctggcgatgagattaatgacttaatcgattctggcgaaattaagacagtcttcaacaagaccagaaggggctctaactcccaaaacaatgaaagaaggctttctgatttgcaacaataccacatctaa

SEQ ID NO: 288 - protein, 86 aa, Saccharomyces cerevisiae
MTRTSKWTVHEAKSNPKYFTHNGNFGESPNHVKRGGYGKGNWGKPGDEINDLIDSGEIKTVFNKTRRGSNSQNNERRLSDLQQYHI

SEQ ID NO: 289 - DNA, 806 bp, Saccharomyces cerevisiae
cttatctcagggtacccataatttcaaccatccttagcttccattaaaaacacaatgagttgcgttactagcgaagcggcttatctgttaattcttgcttgcaaacatcttagctgaaagtgaaaaggcacagcgcacctgctgaatgctcaacgtttgtaataatccgcctatttccgcggaatcaatagggctcctagcaggccgccatcaattttcagcgtgccgcattaaaattatattaccaagatttccatttccgcggctgattcctatcaatattaagtaatcaatcttttcctcgtgattctttgtgatgctcattcacagaggactaattaagacatgtagcacaatatattcatataaaagttggtgcagttaatgattaattgcattgttttccttgtttctttctgttatacctgtcgaattaaacataaagtgtatatgaattttaaggggcacaaataacaaaggattatttatcacctttaataatgcaatcgatcagtaattgtcccatcgggttagtttcaaaaaacacaatcaattcagcttccactattgcagagtgggtagcatgtccatggaaatatatcaacgttgttggttcaggcagatatgtgagcaataaacctgataaaattaccagatatgatttactcaaggctgcccaggaagcggaaatgcaggagttgcttacaagaaatgatatgaaaggtagacataaacgtaataagaaaagtaagatagcattggagactatagcggaagaaaactcttcaactgaaagccttttttaa

SEQ ID NO: 290 - protein, 101 aa, Saccharomyces cerevisiae
MQSISNCPIGLVSKNTINSASTIAEWVACPWKYINVVGSGRYVSNKPDKITRYDLLKAAQEAEMQELLTRNDMKGRHKRNKKSKIALETIAEENSSTESLF

SEQ ID NO: 291 - DNA, 839 bp, Saccharomyces cerevisiae
gtgaaattgagactgataggtgagaggtgaaccaattgagtgaggagtggtttagttacaaatgcagaagaagaagctaaaagagatacgcccatacagagcaatatcaaaatgagcaagaatgaggtcttccgaatggttggttctgacttactatttgatttcactttctctgattcattcaggaagaaaagggcgaagtcctcgaaatgaaaatttcaacatcattaacagaccggcgcgcgcctttacaatttagtatgtacgccaccaataaaagctgcttaaacaataagctagaaagcccaaagggtgttaaatagtacagcgaacccttcagcaacggtacatcaacaaccccttgaaaagaatagagacaatacagctacagtcatccccttctcttgtatttttggccacaattgattgtattacatcatattttgcctgtgcgcttcttctatcttttccgcataaactaggggaaacgcgatgaagaaatggattggctgaaaaatacaacaattgtagtgttattcagtcattcaactgacaaaagtaacaaacacaagaaacgtcaagtccagtgcaatatgcgaaagaacactttagatatggtcactataggtatcgcatgccttgtgggagtctacacgggcacgagatttttcgagcccattgttatcgatagattgcgtaaggatggaaacttgagaacggacattcccatcccagaatacgacgaggacggaaatctgttaaaggtcacgccgtctttatcatccacaccagctgcaccacctacaccacctacacctcctactccaccacaacagtaa

SEQ ID NO: 292 - protein, 112 aa, Saccharomyces cerevisiae
MDWLKNTTIVVLFSHSTDKSNKHKKRQVQCNMRKNTLDMVTIGIACLVGVYTGTRFFEPIVIDRLRKDGNLRTDIPIPEYDEDGNLLKVTPSLSSTPAAPPTPPTPPTPPQQ

SEQ ID NO: 293 - DNA, 1292 bp, Saccharomyces cerevisiae
tagtcagccacacattgacgtacactgtgaacagcctatttctttccatgtatctcagtgcccagcttatgagaactgtcacagcctcccacttgaccctcagagccctctccactccccccctctttcaacatcgccagatagccgccgttgaatggtgcgggacaacccggcctggcctggccaggcaaaaaaggacgcagcacgcctcgagcgttatttccaaatcgggcgtactatcagccaagcccagctcggtatttttagcgcttctcgcaggaaaattggctgagaagtatatatacgcgagaatgttgctcttccatgtctcagtagtcaatgagtgtccagtggtgtttcattctggaccagttgtttggaagtagaactaaaagaaactagatcaagatcatacaacgctgcgcagtagtgaaacttgattaaagcaatagagaactattaagaaaaaaacaaacacatcatcgaaggacgctataagcatgaggaattttttcacgttattttttgcagctatattttcgctaggagcacttatattagccattgttgcatgcgcaggatcaacgaaaaattacagtcccataaataaaatttactgtgcagaattggatctgtcgcagatgaaggtatcgacggtgctcccttctttgagttctgctacgctatcttcgttgggcctgccctcatatataaatatagggctttggtcgtactgtacagtggactcctcgcataacatccaatcatgttcttcgcctcacggtatccagaattttaacctatcgtcattagtgtatgacaatatcaacaacaatgaggctctggagcttatggattccgtggccagtgttgttttgcccgaaaaactaaaaagtaaaatgacatactacaacaatttggtcaagtgtatgttcattaccattcttattggtattgtcttgacctttgtgaatctagtgttcaacgtattgcgctggatcatccacataaggccgctaacgtggtttggtgcctttttttcatttttcgcctttgccgccctattagtcagtataggttcgtgtttgggcacttactcatacatcaaatacatcctaaagcataactatagtgattacggtatttcaatgagcattggtaggaactaccagggtttgatgtggggggctgtcgttggagcattactgaatttcattctatggtgtagcgtgagatcgaggcccaccgtcatctatgcgaacgctccaattgaggaaaaaccattgatttga

SEQ ID NO: 294 - protein, 263 aa, Saccharomyces cerevisiae
MRNFFTLFFAAIFSLGALILAIVACAGSTKNYSPINKIYCAELDLSQMKVSTVLPSLSSATLSSLGLPSYINIGLWSYCTVDSSHNIQSCSSPHGIQNFNLSSLVYDNINNNEALELMDSVASVVLPEKLKSKMTYYNNLVKCMFITILIGIVLTFVNLVFNVLRWIIHIRPLTWFGAFFSFFAFAALLVSIGSCLGTYSYIKYILKHNYSDYGISMSIGRNYQGLMWGAVVGALLNFILWCSVRSRPTVIYANAPIEEKPLI

SEQ ID NO: 295 - DNA, 1139 bp, Saccharomyces cerevisiae
gaggcgacacctgctaatgtttacaattttcccgattggggtgctagaggcatacagtgggctacatggcacagcacggcagtgcagagtgagaaaatatgacttcacgctcgaggcgaggccacgctttcgaagcttcgaatgccactacctagaccattgctgttttgtaccttcacggtcccattagagacattttacttaatgcaagattgccatatccgttgtcatggtaccaaacagggtaataatttctagaaatcatgatacacgtatgacatctgggtaacctaatccatctgggtaaccgatttttctctccctttgctttctctttaccactcagctgactttattattttttttatatttttcattttgacaaaattatatagttaggaagaatacaataggactgcgacagaaacagataagggctcttttttcttggggttggctgcttttattcattaatttaagactcaagtgtgctgcgtgaaatgctctcatactatgaacacaatactgcgttccaaacaaacaattgcaattccggtagcaatgccgccactacatacaacagcgacgccaataatgatacgatcatgaataaaagaaaaaatgaccatttcgagtttgatacacacactttctaccaaagatcgaagagaacaaaacgagattctgtaagtacaaagttttcggtcggttccgggtgtgctaatcttaataacaacaacaacaacatcatcatcaacaacaacaacaacaacaataataataataataaccataatcataataacagcaataatactgcaacctacaataatattcattataaaaaaaatatcgaaatatgtcccctgaaaccggttagtatgcaccacactatgaacagccgcttactgaacgaatctgaattttattctgaaacagaagagtacatgattcatggttatttcggtaacactaatcgcgacataacaggcacgagtcctactggaagtgctagtattatacaacaccagtatcatcttctaccatcccaaagtataattgcatcacaagcacccggtactgccatggccgcgttgactaacaacaatatcgctaacgattacatggatatagattaa

SEQ ID NO: 296 - protein, 212 aa, Saccharomyces cerevisiae
MLSYYEHNTAFQTNNCNSGSNAATTYNSDANNDTIMNKRKNDHFEFDTHTFYQRSKRTKRDSVSTKFSVGSGCANLNNNNNNIIINNNNNNNNNNNNHNHNNSNNTATYNNIHYKKNIEICPLKPVSMHHTMNSRLLNESEFYSETEEYMIHGYFGNTNRDITGTSPTGSASIIQHQYHLLPSQSIIASQAPGTAMAALTNNNIANDYMDID

SEQ ID NO: 297 - DNA, 713 bp, Saccharomyces cerevisiae
taatcaacttggccaagcagaatacgcaatggttgttcggcactgttaaggagcctgcttacaagaggtacctacataacgttaaaaactggtcgaaaagcatattagggttcaactaatgattggggtgtcaacgtaatgtacttttctccccaatttttcttttcatccgtatattttaccgtaaaatggacaagctaatagcaaaacgaaaaaacacgttgtcacttctatataactttgcttaagtaagtattttgtctttataatgttacatactgtgaaatacactctttagaaaacactatttcctcactctcggaagcagatttcgaagttcttccttacttctgagctttgcttctccttccttgcgattaatgttacccggtatacgaaatcggagaggatcagaataaatgcattgaaaggagcataaatctatacagcggtttggcaatggtgagaggaagagaacaaaaaatagaacgcagatagtcatgtccaaatacgcttggtataccagagttacagatacattacatcgtctaacggtactgacgttggttggtggtacgttatacatgtcgggtggcttagcttacactttatacatgaacggtaagaagtacgaacaacaagtgacccaacaaaaggcacttgaagaagacaatcaacaactgcaaagtcctactgcacctcctaccgagtaa

SEQ ID NO: 298 - protein, 70 aa, Saccharomyces cerevisiae
MSKYAWYTRVTDTLHRLTVLTLVGGTLYMSGGLAYTLYMNGKKYEQQVTQQKALEEDNQQLQSPTAPPTE

SEQ ID NO: 299 - DNA, 1640 bp, Saccharomyces cerevisiae
gtaacttggttctatgaatcttcatgtcagatacgtaggacagactctttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccctaaatgtgaaccaacgttacggcacaccgtgatgtacccgcattaaagttttgtaaattcgttattacgattatcgagttggctagatagaaaaccggaaatgtaatggatgcccttttcgaatagctgagtttctttgcctaaaatagcccaatattgttgccctttttctatcacgaggttactgagccattgcatgaacgcgcgcgcctcggcggctttttttttctgctgtgctgtataaaagcgaaaagccagaagttactatctcgaataaaaaacccctcgaactgccatctcactaccgaaaatgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagagattactgaaaacacaccaagttctgatcctcatgattgggaagttgttgcagcaaatctaaattcgtacttatatgaaaataacgtttggaatactaagtacttttttttcaatgccatggtctgtcaagaagcgttcagaacaacccttctcgaaccattttctttgaaaaaagataaagctgccaaggttaagtcatttaaggattccgtcccttacattgaagaagcattgggagtttattttacagaagttgaaaaacaatggaaattgtttaatactgaaaaatcatggagccctgttggcctggaagatgctaaacttcccaaggaagcttaccgatttaagcttacttggtttttaaagaggatttccaatatttttatgttgataccattccttaattttttgtgctgcatatatgtgtcacggggaatgtgccttctattacgcaccttgtatctcgggtggattcttttcatgttggtacaaggtttccaaaatataagggttttgattatgagcatggaacacaagatgcagttcttgtcgactattataaatgagcaagaaagtggtgcgaatggatgggacgaaattgcaaggaaaatgaataggtacttgtttgagaaaaaagcctggaagaatgaagagtttttcttcgacgggattgactgtgaatggttttttaaccacttcttctaccgcgttctatctgcgaagaaatctatgtggcctttaccattgaatgtggaactatggccatacattaaagaagcgcaattatcccgcagtgaggtgctcttagtgtag

SEQ ID NO: 300 - protein, 379 aa, Saccharomyces cerevisiae
MKENELKNEKSVDVLSFKQLESQKIVLPQDLFRSSFTWFCYEIYKSLAFRIWMLLWLPLSVWWKLSNNCIYPLIVSLLVLFLGPIFVLVICGLSRKRSLSKQLIQFCKEITENTPSSDPHDWEVVAANLNSYLYENNVWNTKYFFFNAMVCQEAFRTTLLEPFSLKKDKAAKVKSFKDSVPYIEEALGVYFTEVEKQWKLFNTEKSWSPVGLEDAKLPKEAYRFKLTWFLKRISNIFMLIPFLNFLCCIYVSRGMCLLLRTLYLGWILFMLVQGFQNIRVLIMSMEHKMQFLSTIINEQESGANGWDEIARKMNRYLFEKKAWKNEEFFFDGIDCEWFFNHFFYRVLSAKKSMWPLPLNVELWPYIKEAQLSRSEVLLV

SEQ ID NO: 301 - DNA, 1040 bp, Saccharomyces cerevisiae
accggtattttcatctcttctagatcaagactaactgctcgttcagtacaagtattttacgatagtccatattactcttcaattaatattttttttttatattctggcccgtttttgacacaattttttccttctctttttctccctataaactatgcagaagtagcgataatcacgatcttgttaatgattcacatgtgcgcaagtcgtattgtctgtctagatagtgagatgccttctaaataacaggagagaggcaagatagcataacggcgcaatgaaggtaatttctgccagttttctttgcattgacgactgaaagggcccttgtaagagccgctcgacagggcgacgccacagtagagtcgctaacaccgaaatatgcatattgaaaaacatcaaagtataaaagaacaaagagggtggcatctgcagatcaaaaaaaacaataaccaccaaacaagacactaaaaaaggtcgtaaaaaggtcaaaagttagaatggttaaggtatatattcatgacaacaaggttgactccgattatcgcgcaccccacaattctggaacagaactttccctggatgaattagccaagttaggagtgatttataaatactgtgcaaatgaggaagaagtgaatgaaattgctaggcaaagagaatataaaaatagagatgtggtcaacatctgcgaaggttccttcaaaagtgaagcagagtttaatgaaaaactagcaacattctaccaagagcatttacatgaagacgaagaaataagatactgtctcgagggtgctggatactttgacgtcagggatgcttccacaccagagaactggattaggtgtttggtagagtcaggtgatttactgattcttccaccaggcatctatcatcgtttcaccttgacaactagcaaccacatcaaggccttgagactgtttaaggacgagcccaaatggcaagctatcaacaggtcaaatcaggctgattcattgcctgtacgcaaggactacattgccctgatcaatcagtactaa

SEQ ID NO: 302 - protein, 179 aa, Saccharomyces cerevisiae
MVKVYIHDNKVDSDYRAPHNSGTELSLDELAKLGVIYKYCANEEEVNEIARQREYKNRDVVNICEGSFKSEAEFNEKLATFYQEHLHEDEEIRYCLEGAGYFDVRDASTPENWIRCLVESGDLLILPPGIYHRFTLTTSNHIKALRLFKDEPKWQAINRSNQADSLPVRKDYIALINQY

SEQ ID NO: 303 - DNA, 2126 bp, Saccharomyces cerevisiae
gcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaagcagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacataatgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 304 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 305 - DNA, 1361 bp, Saccharomyces cerevisiae
aagctgtgccaaacaaggtcatctccaaatacttaccaaaaagctagggcgtactgtactggaatctctgcttttttctttaccttacttcaatttgccttgtctgcttttttacgtgtgttttggcgtttctgcttttcttttttattactcgttgttgtaaatcattttctaagtattatacatactatatcatcgcatacccaatcggtttcctattctcaccacttttttctggaaaaatacatagcctaacaagcaattttattttacgtttgttaattcattatactgataatatttttgaattttttttttttttgatacattttttttaatcgctgttttgtctgtttttttcgattcagttatagggaaaaaaacgggaaaggaaagagaaaaaaaaattagtgcagagcaataagaagcgaaaatcaaaaaaaagttttggatctgcaagacttgctgtcacgcaacaatattatagccacccagcaaaaatgtcagacatcgaagaaggtacgcctactaataatgggcaacagaaggagagaagaaagatagaaattaagttcatcgagaataaaacaaggcgccatgtgacattttccaaaaggaagcacggtatcatgaaaaaggcgtttgagctttctgttctaacggggacccaggtcctgttgctagtcgtttcagaaacaggtttggtatatactttcagcacgccgaagtttgaacctatagtcacgcagcaggaaggtagaaacctgatccaggcctgtcttaacgcccctgatgatgaggaagaagacgaggaggaagacggtgatgatgatgatgatgatgacgatgatggtaatgatatgcaacgccagcaaccacaacaacagcaaccgcaacaacagcaacaagtattgaatgcacacgcaaatagcttaggccatctaaatcaagatcaggtaccggcaggcgcgctgaaacaagaggtgaagtcacaattgctaggcggtgccaatcctaatcaaaactcaatgattcaacagcagcaacatcacacgcagaattcacaaccacaacagcaacagcaacaacaaccacagcagcaaatgtcacagcaacaaatgtcacagcatcctcgaccacagcaaggaataccacatccgcaacaatcgcagccacagcaacagcaacaacaacaacaacaactgcaacagcagcaacagcagcaacaacaacaacccctcaccggcattcatcagcctcaccaacaggcttttgccaacgctgcctccccctatctgaatgctgaacagaatgctgcctaccaacaatactttcaagaaccgcaacaaggccaatactaa

SEQ ID NO: 306 - protein, 286 aa, Saccharomyces cerevisiae
MSDIEEGTPTNNGQQKERRKIEIKFIENKTRRHVTFSKRKHGIMKKAFELSVLTGTQVLLLVVSETGLVYTFSTPKFEPIVTQQEGRNLIQACLNAPDDEEEDEEEDGDDDDDDDDDGNDMQRQQPQQQQPQQQQQVLNAHANSLGHLNQDQVPAGALKQEVKSQLLGGANPNQNSMIQQQQHHTQNSQPQQQQQQQPQQQMSQQQMSQHPRPQQGIPHPQQSQPQQQQQQQQQLQQQQQQQQQQPLTGIHQPHQQAFANAASPYLNAEQNAAYQQYFQEPQQGQY

SEQ ID NO: 307 - DNA, 1394 bp, Saccharomyces cerevisiae
aacagttcacctcgatctacatatatttcaatgcgagaatgattaattcttgccattgacaaacaacccttttactgccagcgcctttcataaccatgtagttttatatgcctaattataataaagcatgacatataatgccaaccccatatttatatagttaacttgaaaccgagattcatctattgcaccaggaaaagtgccttcttcttaaaacataagttacgtcccgaccattcatctaaacggcatcaatcattgcagcagaagaaatagtgtgtagatgtcctcgttcgctagacgcagtcaatgataacaaggtctttcttcaagctgtctttccataaaaaggtatcgcaaatggggtcaccaatgcgccttttatttttcacgccgaaagaaaacttagtaggtccctagaaatgaataaagaggtgattctgaggttcattataagcctttggtaaaacttgaaccaagaaagattaaaacacaaagccatgcctatcaaagaaactgataaagaagttgttttgactcatccagctgatgagaccaccagcgttcatattctaaagtacggtgctacagtttattcttggaaattgaaatctgaagaacagttgtggttgtctactgctgctaaattggatggtagcaaacctgtgagaggtggtatacctttggtctttcctgtattcgggaaaaatagcaccgatgaacatttgagtaaattacctcaacatggtcttgcaagaaattctacttgggagtttttgggtcaaactaaggaaaacccaccgaccgtacaatttggcttgaaaccagaaattgctaacccagaattgaccaaattgtggccaatggattatcttttgattttgactgttgaattaggctccgattatttgaaaactgccatagaagtagaaaacacatctagttccaaggaattaaagttcaactggttgttccatacatacttccgtatcgaagatattgaaggaacaatggtctctaatttagctggcatgaaactttatgaccaactgttgaaggaatcctacgtcgacaagcacccagtcgttaccttcaatcaagaaaccgatgtaatttatcagaatgtcagcgccgaacgggccattcaaatagttgacaagggcgttcaaattcacactctaaaaagatacaacttgcccgacactgttgtttggaatccatggattgagaagtctcaagggatggccgatttcgaaccaaaaactggttaccaacaaatgatatgtattgaacctggtcatgttcatgattttatttccttggctcctggtaaaaaatggaatgcttatcaattactttgcaaagaagaattgaaatatcaagctattcaataa

SEQ ID NO: 308 - protein, 297 aa, Saccharomyces cerevisiae
MPIKETDKEVVLTHPADETTSVHILKYGATVYSWKLKSEEQLWLSTAAKLDGSKPVRGGIPLVFPVFGKNSTDEHLSKLPQHGLARNSTWEFLGQTKENPPTVQFGLKPEIANPELTKLWPMDYLLILTVELGSDYLKTAIEVENTSSSKELKFNWLFHTYFRIEDIEGTMVSNLAGMKLYDQLLKESYVDKHPVVTFNQETDVIYQNVSAERAIQIVDKGVQIHTLKRYNLPDTVVWNPWIEKSQGMADFEPKTGYQQMICIEPGHVHDFISLAPGKKWNAYQLLCKEELKYQAIQ

SEQ ID NO: 309 - DNA, 848 bp, Saccharomyces cerevisiae
agagcagaaatgatgaagggtgttagcgccgtccactgatgtgcctggtagtcatgatttacgtataactaacacatcatgaggacggcggcgtcaccccaacgcaaaagagtgacttccctgcgctttgccaaaaccccatacatcgccatctggctcctggcagggcggttgatggacatcagccgcctcccttaattgctaaagcctccacaaggcacaattaagcaatatttcgggaaagtacaccagtcagtttgcgcttttatgactgggttctaaggtactagatgtgaagtagtggtgacagaatcagggagataagagggagcagggtggggtaatgatgtgcgataacaatcttgcttggctaatcacccccatatcttgtagtgagtatataaataggagcctcccttcctattgcaactccataaaatttttttttgtagccacttctgtaacaagataaataaaaccaactaatcgagatatcaaatatgggtagtttttgggacgcattcgcagtatacgacaagaaaaagcacgcagatccaagtgtatatggaggaaaccataacaacacaggagacagtaaaacgcaggttatgttttcgaaagagtaccgtcaacctaggacacatcagcaagagaacttgcagagcatgagaagatcttccataggatcacaggacagttccgatgttgaggacgttaaggaagggagattacccgcagaagtagaaataccaaagaatgttgacatctctaacatgtcgcaaggtgagtttttaagactttacgaaagtttgaggaggggggaacccgacaataaagtaaatagataa

SEQ ID NO: 310 - protein, 115 aa, Saccharomyces cerevisiae
MGSFWDAFAVYDKKKHADPSVYGGNHNNTGDSKTQVMFSKEYRQPRTHQQENLQSMRRSSIGSQDSSDVEDVKEGRLPAEVEIPKNVDISNMSQGEFLRLYESLRRGEPDNKVNR

SEQ ID NO: 311 - DNA, 2099 bp, Saccharomyces cerevisiae
aagagagagaagctagattatcattacagcagccacatagtataccaaattccagtacaggcacaccagaacatgatcaagacacttagaggaaatggaacaacgaatttccagccaaaaattccgagtagttcatgatgaaagatttttacatgcattttatatataaatatataccgtcctatatggatttcatgccaacagggtatataatagacaattaccggtgtactgatatatcaactatcgactccaagccttttatctatcagtcaattttacatcaagatcccacttttagataggttcgaaaattcaatctaatattagtgatttaattagatggtggattgcttacccttttttttgtcgttttaggaggagattcttcggattttagggataaacggatactccatatataaaaaacaaaacttcaggcatattgattatctaaaaggaatattctaaaaccatagccatagtaatttatcaccaacatgtcaaacgacggctcaaaaatattgaattataccccagtgtctaaaatagatgaaatagttgaaatctcaagaaatttcttctttgagaaacaattgaaattgtcccacgaaaataacccaaggaaaaaagatctagaattcaggcagttgcagttgaaaaaactctattatgccgtcaaagatcatgaggaagaactgatcgatgctatgtacaaggactttcatcggaacaaaattgaatcggttctgaatgaaacgaccaaacttatgaacgatatacttcacctaattgagattttaccaaaattgatcaaacctcggagagtatctgattcttctcctccatttatgtttggtaaaacaatcgtggagaaaatatcaaggggcagtgtcttgattattgctcctttcaattttcccctacttttagcatttgccccattggcagcagctcttgctgcaggtaacaccattgttctgaagccaagtgaactaacaccacacactgctgtagttatggaaaatttgttaaccacagctggtttccctgatggattgattcaagtagttcagggagctatagatgaaactacaagactactagattgtggaaaatttgacctaatattctacacaggttctccccgtgtcggatcaatagttgctgagaaagcagcaaaaagtctaacaccttgtgtacttgaacttggtggtaaatcacctacctttattacagaaaatttcaaagcaagtaacataaaaattgctttgaaaaggattttttttggtgctttcggaaattctggccagatttgtgtttcaccagattatttgttagtacataaatctatctatccaaaagtcattaaagagtgtgaatcagtactaaatgaattttatccaagctttgatgaacaaacagatttcactcgtatgattcatgagcctgcttacaaaaaggccgttgcaagtataaactcaactaacggctccaagattgtgccttcaaaaatttctatcaattcagatactgaggatctatgccttgtaccaccaaccatagtttataacattggttgggatgatcctttgatgaaacaggaaaactttgctcctgtattgcccatcattgagtacgaggatcttgatgagaccattaacaagataatagaagaacatgacactccattggtgcaatacatattctctgatagccaaactgaaataaatcgtatcttgacgcgcttaagatctggtgactgtgttgtcggtgatacagtgattcatgtaggaattaccgacgctccatttggagggatcggtacttcaggttatggtaactatggtggatattatggattcaatacctttagtcatgaaagaacaatttttaaacaaccatattggaatgattttaccctttttatgagataccctccaaatagcgcacaaaaggaaaagctcgtccgttttgcgatggaaagaaaaccttggtttgacagaaatggcaataacaagtgggggttacgccaatatttttcattatctgccgccgttattttaattagtaccatttacgctcattgttcttcctga

SEQ ID NO: 312 - protein, 532 aa, Saccharomyces cerevisiae
MSNDGSKILNYTPVSKIDEIVEISRNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 313 - DNA, 1793 bp, Saccharomyces cerevisiae
aaacaagtgtaacataaatacattctgtaaatctacaaaaatcgttagtgctgttttctttttgagattgaaaagtacgaatcatacacatctcttattctgagaagggtgcatatgacgtaaatcaatgcgtacaaagcggtttccggtgctggcctggcccaccacagttttggcgtggttgattttaaaaaccttcgggaaggtgaaaaaaccactccgaaggttcgaggatgacaaatcgccccttagctgtggccatacaagcttggcaccgacgaaaaagggaaaaaggaaaagaatgtcgtacaagaactcttacaaccacgttgagatttcatttaacaacgcccccctttccattatataagaaggcattaatttttatgtaataaaaaaagaatttctcgaaaatgtcttacaattaattttttcttttgtagagtagggctttaatagactgatatatacggtattataagtgaacgaaaaaaacagcaatgggtttatttgataaagtgaagcaatttgctaacagcaataataacaacaatgattctggcaataacaatcaaggcgattatgttaccaaagctgagaatatgatcggcgaagatagagtcaatcaattcaaaagcaaaatcggagaggacagatttgataagatggagtccaaggttcgtcaacaattttctaatacctctataaatgacaacgactccaacaacaacgactcatatggttctaataacaacgattcatatggttctaacaacaatgattcatatggctctaacaacaatgattcatatggctccaacaacaatgattcatatggctctaacaacgatgattcctacggttcttccaacaagaagaagagctcttatggttctaacaatgacgattcgtacggctccagcaacaacaatgactcttacggttccaacaacaatgactcttacggttccaacaacaatgactcttacggttccaacaatgacgactcttacggttcgtcaaacaagaataagagctcttacggttccaacaatgacgattcttatggctctaacaatgatgattcatatggttcttccaacaagaagaagagttcttatggttccagcaacaacgattcgtatggttctaacaacgatgattcatatggttctaacaacaatgattcatatggctctaacaacgatgattcctacggttcttccaacaagaagaagagctcttatggttctaacaatgacgattcgtacggctccagcaacaacaatgactcttacggttccaacaatgacgactcttacggttcgtcaaacaagaataagagctcttacggttcttctagcaacgatgattcttacggatcttccaataacgacgactcttacggttcttccaacaagaagaagagttcttatggttccaacaatgacgattcttatggctctaacaatgatgattcatatggttcttccaacaagaagaagagttcttatggttccagcaacaacgattcgtatggttctaacaacgatgattcctacggttcttctaacaaaaagaagagttcttatggttccaacaacgatgattcatacggctccagcaacaacaatgactcttacggttccaacaatgacgactcttacggttcctctaatagaaacaagaactcctatgggtcttccaactacggttcatccaacaatgatgactcttatggttcatctaatagaggcggtcgtaatcaatacggtggtgacgacgattactaa

SEQ ID NO: 314 - protein, 430 aa, Saccharomyces cerevisiae
MGLFDKVKQFANSNNNNNDSGNNNQGDYVTKAENMIGEDRVNQFKSKIGEDRFDKMESKVRQQFSNTSINDNDSNNNDSYGSNNNDSYGSNNNDSYGSNNNDSYGSNNNDSYGSNNDDSYGSSNKKKSSYGSNNDDSYGSSNNNDSYGSNNNDSYGSNNNDSYGSNNDDSYGSSNKNKSSYGSNNDDSYGSNNDDSYGSSNKKKSSYGSSNNDSYGSNNDDSYGSNNNDSYGSNNDDSYGSSNKKKSSYGSNNDDSYGSSNNNDSYGSNNDDSYGSSNKNKSSYGSSSNDDSYGSSNNDDSYGSSNKKKSSYGSNNDDSYGSNNDDSYGSSNKKKSSYGSSNNDSYGSNNDDSYGSSNKKKSSYGSNNDDSYGSSNNNDSYGSNNDDSYGSSNRNKNSYGSSNYGSSNNDDSYGSSNRGGRNQYGGDDDY

SEQ ID NO: 315 - DNA, 1601 bp, Saccharomyces cerevisiae
actccagagcgcaagagttcgttcatctacgaaatgttgctggcattggcatctccacaagatgacatcccaacgccggatgaaatcgaaaagaaaaataagctaaaggaaacaacaacgagaaactatagaggaacatgttgagttgaaaaggtcatccaatataccgccccctatatgtatgtacctttaccttttatttaagtactagtgctgtttagttaggttatgtgaaggcacgggttttgtctttttttttttttttttttactattactttctttttcaagcttttaagcgccgaaatgatatttaagggaagatgactaaagggacagcgacgaggattcagcctggacagtgatagaaaagttatgcgggaatacgtatatatagttgtataaattgtggttatagaacatcgcagcgcctttaaatatattgtcttttatttcaatcttattccatctctctcttgcaaccacggcaaagctggagctatgtctgaaaaatcagctagcaataacaaagctgaattcaaaaggcagtcatcgccattcagagaaatcatctctgcggatcacccaatttataaacctgctaagggaaggtactggctgtatgtggcgctaccatgcccatgggcacaaagaaccttgatcaccagggccctgaaagggctagcgcctataatcgggtgcagtgtagcgcattggcacctggatgacaaaggctggcgattccttgaagaaggagatgggaaaaccaatgaaaggcactggtttgacattgcaggcggaattagctcagtaaatttaaataccagtactcctgtggctaacatacccaataacgcgcatcggttgttggtcgacggaacagatgaaccgcattacgggtacaagagactaagcgacttctatttcaaaacaaagccagactataagggaagattcaccgtacctgttctttgggacttggaaacatgcactatagtaaacaatgaaagcagtgatatcatcggaattatgaattccgctgcgtttgatgagtttgtcggcgaagaataccgtcaagtccgtctggtacctcggtctctagaggcacagattacagagttcaactcttgggtgtacgataaaatcaacaacggtgtatacaaggccggttttgcagaatgtgcagaggtatacgagagggaggtaacaagcctttttcaatatcttgacaaattggaaaatcttctggacaagaagtacacagatttggaggcggagtatggtaagaacaacaaggacaagatactagatcgctactttgccatcggagacactctgaccgaggcggacgtgagactctacccaacgatagtaaggttcgacgtggtataccatcaacacttcaaatgcaatctggccaccatcagagatgattattcccgtatacacacgtggctcaagaatatatactggcgccacgaagccttccagcgcacaacggactttacccacataaaactcggatatactcgctcgcagccacgggtcaacccgattgggatcaccccactggggcccaagcctgatatccgacctccatga

SEQ ID NO: 316 - protein, 366 aa, Saccharomyces cerevisiae
MSEKSASNNKAEFKRQSSPFREIISADHPIYKPAKGRYWLYVALPCPWAQRTLITRALKGLAPIIGCSVAHWHLDDKGWRFLEEGDGKTNERHWFDIAGGISSVNLNTSTPVANIPNNAHRLLVDGTDEPHYGYKRLSDFYFKTKPDYKGRFTVPVLWDLETCTIVNNESSDIIGIMNSAAFDEFVGEEYRQVRLVPRSLEAQITEFNSWVYDKINNGVYKAGFAECAEVYEREVTSLFQYLDKLENLLDKKYTDLEAEYGKNNKDKILDRYFAIGDTLTEADVRLYPTIVRFDVVYHQHFKCNLATIRDDYSRIHTWLKNIYWRHEAFQRTTDFTHIKLGYTRSQPRVNPIGITPLGPKPDIRPP

SEQ ID NO: 317 - DNA, 680 bp, Saccharomyces cerevisiae
atcccgttgaagcaaccgcactatgactaaatggtgctggacatctccatggctgtgacttgtgtgtatctcacagtggtaacggcaccgtggctcggaaacggttccttcgtgacaattctagaacaggggctacagtctcgataatagaataataagcgcatttttgctagcgccgccgcggcgcccgtttcccaatagggaggcgcagtttatcggcggagctctacttcttcctatttgggtaagcccctttctgttttcggccagtggttgctgcaggctgcgccggagaacatagtgataagggatgtaactttcgatgagagaattagcaagcggaaaaaaactatggctagctgggagttgtttttcaatcatataaaagggagaaattgttgctcactatgtgacagtttctgggacgtcttaacttttattgcagaggactatcaaatcatacagatattgtcaaaaaaaaaaaagactaataataaaaaatgaagttatctcaagttgttgtttccgccgtcgccttcactggtttagtaagtgctgctaacagttctaacagctcaagctcaaagaatgctgcccaaccaattgccggtttaaacaacggtaaggttgcaggcgccgctggtgttgctctagctggtgctttggcctttttgatttaa

SEQ ID NO: 318 - protein, 59 aa, Saccharomyces cerevisiae
MKLSQVVVSAVAFTGLVSAANSSNSSSSKNAAQPIAGLNNGKVAGAAGVALAGALAFLI

SEQ ID NO: 319 - DNA, 683 bp, Saccharomyces cerevisiae
cttttcagttatttaccttcctttctctcacgtgtaaatatttgtgtgtcatacacaccgctaaaaacctttgcatcaacttataccctacatttctatagacgctatttggaaacaagatgtaaccctttttttcttttagttttgagatttgtactcgtaaagagtacgtttatttatttattcaaattttattcttcataccatgtaaatataagcgcatataatcactacgatcttagtacagctagaattgctgacgcttacaattgctttattgtttgattatatgcacgtatacatatagtgtcagcaaaaaaaaaaaaaggcagtacttgattggctacgccgcgcatcgtccgagaaatccggcctggtaggggcaggtttgaaaaggcggatagaaataaaagatgatattatttattcatcccatgaatagtagaactcgatataagattctaaaccaacaagtacagaaagcaaaacaataataaataatggctaataaagttattcaactacagaaaatcttccaatcttccactaaacctctatggtggagacatccaaggtcagctttatacctgtatccattttatgctatttttgcggtagccgtcgttacaccacttctatacattccaaatgctattagaggtatcaaagccaagaaggcatag

SEQ ID NO: 320 - protein, 60 aa, Saccharomyces cerevisiae
MANKVIQLQKIFQSSTKPLWWRHPRSALYLYPFYAIFAVAVVTPLLYIPNAIRGIKAKKA

SEQ ID NO: 321 - DNA, 3248 bp, Saccharomyces cerevisiae
aaattggtctcaatctggaataagtgctacttcgcactgctggtccttggattaatatccctgaaggataccttacaaactctggtaggaactcctggttatagaataaccctttagccttttttacgtacttgtataccgtttaaaatttcctatgtactataaccttttttcactactattatggaattctatcgagcgaccgggcttttgttacggaagagtgaaaaaatcgagttttggtgttttggtgaaagaatttggaggactataaagtacctatactttgtattacggactcaataacaagtcgttcgtgtcagtggtattgaagttgtcagatctaagagtagagagaaggtggcatctaataggtttcgacgtttttctttttttaaggtttttatttggtctcctagaatttaaggtcttagttagttttggtttgttttgtgggttacatattttcaattcaaaggagaatttagctgtcttttataatgtccaatagagataacgagagcatgctgcgtactacatcaagcgataaggcgatcgctagtcaaagggataaacggaagtctgaagttttgattgctgcacagtcccttgacaatgaaatccgcagcgtaaaaaacctaaaaagattgtcgattgggtcaatggatttacttattgatccagaattagatataaaattcggtggggaatctagtgggagacgatcatggtctggcacgacatccagttctgcgtcaatgccaagtgacacaaccaccgttaataacacacgatatagcgatccaactccgctagagaacttgcatgggaggggtaactcagggatagaatcctccaataagactaaacaaggtaactacttaggtataaaaaaaggtgttcactctccatccaggaaattaaatgctaacgtattaaagaaaaacttattatgggttcccgccaatcaacaccctaacgttaagcctgataatttcctagagcttgtacaagatactttacaaaatatacaactaagcgacaatggtgaagataatgatgggaatagcaatgaaaataacgatattgaggataatggggaggataaagaatcacaatcatatgaaaataaggagaacaacactatcaacttgaacagggggctgtcaaggcatggaaacgcgtcactaatacgaaggccttcaacattgcggaggtcatatacagagtttgatgataacgaagatgacgataataagggagacagtgcctctgaaacagtaaataaagtcgaagaaagaatctccaaaataaaagagagaccagtgtcgttaagagatataactgaagaactgacaaagatctcaaatagtgcaggactaaccgacaatgatgccattacattagccagaactcttagtatggctggttcatattcagataaaaaagatcaaccacaaccggaagggcattatgatgaaggagatattggtttttcaacttcacaagcgaatactttggatgatggtgaatttgcctccaatatgcccatcaataataccatgacatggcctgaacgatcgtcactgagaaggagtagattcaacacttatcgaatcaggtcacaagagcaagaaaaagaagtagaacaaagtgtggatgaaatgaaaaacgacgacgaagaacgtctaaaattgaccaagaatacaataaaggtcgaaatagatccgcacaaatccccttttagacagcaagatgaggattctgagaatatgagttcgcctgggtcaattggtgattttcaagacatttataatcattacagacagtctagtggcgagtgggaacaagaaatgggaatagagaaagaagccgaagaggtacccgtcaaggttcgaaatgacacagtagaacaagacttagagttaagagagggaacaacagacatggtaaagccaagcgcaacggatgacaacaaagaaacgaagcgacatcgtcgaagaaacggatggacatggttgaacaataaaatgagcagagaagacgataacgaagaaaaccaaggggacgatgaaaatgaagaaaacgtggattcacaaagaatggagctcgacaattccaaaaaacattatatttctctatttaatggcggtgagaagacggaggtgtcaaataaagaagaaatgaacaattcaagtacttccaccgccacatcacagacaagacagaaaatcgagaaaacttttgcgaacctattcagaagaaagccacaccacaagcatgatgcatcatcatcaccctcgtcgtcaccatcatcgtcaccatcaataccaaataacgatgccgtgcacgttcgcgtgaggaaaagcaaaaagcttggtaacaaaagtggaagggagccggttgaacccattgtgttgcgcaatcgccctcgtcctcaccgtcaccatcacagccgtcatggttcccaaaaaataagcgtaaaaacccttaaagattctcagccgcagcagcagataccattacaaccacaattggaaggcgcaatagagatagaaaagaaagaggaaagcgattccgagagcttgccccaactacagccggccgttagtgtaagtagtaccaaaagtaactctagagacagagaagaagaggaggcaaagaaaaagaacaagaagaggagcaatacgacagaaatttccaaccaacaacactccaaacacgtccaaaaggagaataccgatgagcaaaaagctcaactacaagctccagctcaagaacaagtccaaacttcagtcccagttcaagcttcagccccagtccaaaattcagccccagtccaaacttcagccccagttgaagcttcagctcaaactcaggctccagcggcaccaccattgaaacatacctccatattgcccccaagaaagcttacatttgcagacgtcaaaaaacctgacaaaccaaactccccggttcaattcacagacagtgcctttgggttcccactgcctttgctgacagtgtctacggttatcatgttcgaccaccgtctaccaattaacgtcgaaagggccatataccggctgagtcacttgaaattgagcaattcgaagaggggactgcgcgagcaggtattactaagtaacttcatgtatgcttatctgaacttggttaatcacactctgtacatggagcaggtagcccacgacaaagaacaacaacaacaacaacaacaacaaccctga

SEQ ID NO: 322 - protein, 915 aa, Saccharomyces cerevisiae
MSNRDNESMLRTTSSDKAIASQRDKRKSEVLIAAQSLDNEIRSVKNLKRLSIGSMDLLIDPELDIKFGGESSGRRSWSGTTSSSASMPSDTTTVNNTRYSDPTPLENLHGRGNSGIESSNKTKQGNYLGIKKGVHSPSRKLNANVLKKNLLWVPANQHPNVKPDNFLELVQDTLQNIQLSDNGEDNDGNSNENNDIEDNGEDKESQSYENKENNTINLNRGLSRHGNASLIRRPSTLRRSYTEFDDNEDDDNKGDSASETVNKVEERISKIKERPVSLRDITEELTKISNSAGLTDNDAITLARTLSMAGSYSDKKDQPQPEGHYDEGDIGFSTSQANTLDDGEFASNMPINNTMTWPERSSLRRSRFNTYRIRSQEQEKEVEQSVDEMKNDDEERLKLTKNTIKVEIDPHKSPFRQQDEDSENMSSPGSIGDFQDIYNHYRQSSGEWEQEMGIEKEAEEVPVKVRNDTVEQDLELREGTTDMVKPSATDDNKETKRHRRRNGWTWLNNKMSREDDNEENQGDDENEENVDSQRMELDNSKKHYISLFNGGEKTEVSNKEEMNNSSTSTATSQTRQKIEKTFANLFRRKPHHKHDASSSPSSSPSSSPSIPNNDAVHVRVRKSKKLGNKSGREPVEPIVLRNRPRPHRHHHSRHGSQKISVKTLKDSQPQQQIPLQPQLEGAIEIEKKEESDSESLPQLQPAVSVSSTKSNSRDREEEEAKKKNKKRSNTTEISNQQHSKHVQKENTDEQKAQLQAPAQEQVQTSVPVQASAPVQNSAPVQTSAPVEASAQTQAPAAPPLKHTSILPPRKLTFADVKKPDKPNSPVQFTDSAFGFPLPLLTVSTVIMFDHRLPINVERAIYRLSHLKLSNSKRGLREQVLLSNFMYAYLNLVNHTLYMEQVAHDKEQQQQQQQQP

SEQ ID NO: 323 - DNA, 812 bp, Saccharomyces cerevisiae
gttttgacaccgagccatagccgtgattgtgcgtcacattgggcgataatgaacgctaaatgaccaactcccatccgtaggagccccttagggcgtgccaatagtttcacgcgcttaatgcgaagtgctcggaacggacaactgtggtcgtttggcaccgggaaagtggtactagaccgagagtttcgcatttgtatggcaggacgttctgggagcttcgcgtctcaagctttttcgggcgcgaaatgcagaccagaccagaacaaaacaactgacaagaaggcgtttaatttaatatgttgttcactcgcgcctgggctgttgttattcggctagatacatacgtgtttgtgcgtatgtagttatatcatatataagtatattaggatgaggcggtgaaagagattttttttttttcgcttaatttattcttttctctatcttttttcctacatcttgttcaaaagagtagcaaaaacaacaatcaatacaataaaataatgtccggtagaggtaaaggtggtaaaggtctaggaaaaggtggtgccaagcgtcacagaaagattctaagagataacattcaaggtatcactaagccagctatcagaagattagctagaagaggtggtgtcaagcgtatttctggtttgatctacgaagaagtcagagccgtcttgaaatccttcttggaatccgtcatcagggactctgttacttacactgaacacgccaagagaaagactgttacttctttggatgttgtttatgctttgaagagacaaggtagaaccttatatggtttcggtggttaa

SEQ ID NO: 324 - protein, 103 aa, Saccharomyces cerevisiae; identical to SEQ ID NO: 38

SEQ ID NO: 325 - DNA, 911 bp, Saccharomyces cerevisiae
caacagcccaggcgcgagtgaacaacatattaaattaaacgccttcttgtcagttgttttgttctggtctggtctgcatttcgcgcccgaaaaagcttgagacgcgaagctcccagaacgtcctgccatacaaatgcgaaactctcggtctagtaccactttcccggtgccaaacgaccacagttgtccgttccgagcacttcgcattaagcgcgtgaaactattggcacgccctaaggggctcctacggatgggagttggtcatttagcgttcattatcgcccaatgtgacgcacaatcacggctatggctcggtgtcaaaacatagtttgcgtgataacagcgtgttgtgctctctcgcgttgcttcttgtgaccgcagttgtatataaataatctttttcttgttcttttatataggaccactgttttgtgacttccactttggcccttccaactgttcttccccttttactaaaggatccaagcaaacactccacaatggccagaactaaacaaacagctagaaaatccactggtggtaaagccccaagaaaacaattagcctccaaggctgccagaaaatccgccccatctaccggtggtgttaagaagcctcacagatataagccaggtactgttgccttgagagaaattagaagattccaaaaatctactgaactgttgatcagaaagttacctttccaaagattggtcagagaaatcgctcaagatttcaagaccgacttgagatttcaatcttctgctatcggtgctttgcaagaatccgtcgaagcatacttagtctctttgtttgaagacactaatctggctgctattcacgctaagcgtgttactatccaaaagaaggatatcaaattggccagaagactaagaggtgaaagatcatga

SEQ ID NO: 326 - protein, 136 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 327 - DNA, 3143 bp, Saccharomyces cerevisiae
cttgatggatttatgtgacgttgtagaatctaagtttactgaaaaaatcaagagcatgtagatgttacggatcgactcaaagaccctctgtcactctgaaatttctaataattatgcacaccacgctagtatagatacagcttgatttgtgtatcccgtttatagtcgtgctatttaaaatctatgtataatataaccagataaaaatacaccttcgtacaaggtgctaataatgttgagaattcgaaattcctttttaaaggcgtattccgtattgaatgattgaaaaatttatttctttttttatttcttttttttttttttttttttttttttacgccgatgctcatcgcagaaaatttttccttcagtttatttgtcttataaaaagactgtcctacgctcaaataacttatacttttctgtatctcattcaaattattttcttgtcaacaacctgtaacagaattaagcactattaaggcaaatttagagcaaatatgacttacggtggtagagatcagcaatataacaagactaactacaagtctagaggtggcgacttccgcggtggaagaaactctgatagaaactcttacaatgacagaccacaaggcggtaactaccgtggtggtttcggtggtcgttccaattacaaccaaccccaggaattgatcaaaccaaactgggatgaagaattacccaaattgccaactttcgaaaagaatttctatgttgaacacgaaagtgttcgcgacagatcggacagtgagattgctcagttcagaaaggaaaatgaaatgactatttccggacacgatattccaaagccaatcaccactttcgatgaagctggtttcccagactacgttttgaatgaagtgaaggctgaaggatttgacaaaccaactggcattcaatgtcagggttggccaatggctttatctggtagggacatggttggtattgctgccactggttccggtaagactttgtcttattgtttaccaggtattgttcatatcaacgctcaaccattattggctccaggcgatggaccaattgttttggttttggctccaactagagaattggctgttcaaattcaaacagaatgttccaagtttggtcatagttccagaatcagaaatacctgtgtctacggtggtgttccaaaaagtcaacaaatcagagatttatctcgtggctctgaaattgttattgctactccaggtcgactaattgatatgctagagattggtaagactaatttgaagagagtcacttacctggttcttgatgaagctgatagaatgttagatatgggttttgaacctcaaatcagaaagattgttgatcaaatcagacctgatagacaaaccttgatgtggtctgccacttggccaaaggaggtgaagcaactagccgctgattacttgaatgatccaattcaagttcaagttggttctctagaactatctgcctcccataatattactcagatcgtcgaagttgtttctgatttcgaaaagagagatcgtttgaacaagtacttagaaacagcctctcaagacaacgaatacaagacattaatctttgcttctacgaaaagaatgtgcgatgatatcaccaagtatctaagagaagatggatggcccgccttggctattcatggtgacaaagaccaaagagaacgtgactgggttctacaagagtttagaaacggtagatccccaattatggttgctactgatgtggccgccagaggtatcggtatgttaaaattttctccatttttttattgattttatttttttttgttacccctaacgatattacagctatttcctaatggcttttaatgacattaatgactttatgacaaccatgatagtacagaagagagaccttttttcttttttttttttttttcttttttttttttttttctttttttcttttttttttttttgagccttttcgaatctagactctatgtgagtctattctcgatggggagtatcggaaattgaattttaattcgaatgacttctaatgcatcactacagaaaactaatattgggaggatgagaaaaattgactttaattagtcgttttgagagacgggaaattataaactcggagaagtgtatttgtgttcatgatttgcacttcatgtcaaaagaaatttcgctttttgacatcggcgcaaataaacaaggaattggcttttcagcttatttctagaacgcatacatacgcttcgttgatcgttgtttttttcaatgcttggcatttgtacaagggtagattgttttattggaaaaataatagtatattctactttgaaatgccgtcatccttcttgactattgttattctcattttgtgtagtttatgcattttgtagttatattgagatactgttgcatcccaagttcgaattattaagaagtgctgataaaaatggaaaataacaaaataaaaggatttcaaccatattcagaaatcatttactttgttttcctttttttaagtgctagctttcattcagtttgaataaggattctggagtattgatgattaaatatttcgaattctttaataaaaatataatttctgataatcttcaagccagggggaaatttgagacaatgttgggagtccaaacatgaatttgtggggggcatgaaaataaagttcatatacagaataacgaaccaaattactaacagtatgctttgtaaacgtttgtttacttctttattttttcagatgtcaaaggtatcaattacgttatcaactacgatatgccaggtaacattgaagattatgttcacagaatcggtagaactggtagagcaggtgctactggtactgctatatctttcttcaccgaacaaaacaaaggtttaggtgctaaattaatctctatcatgagagaagctaatcaaaatattcctcccgaattattgaaatacgacaggagatcttatggtggcggtcacccaagatacggtggtggtcgtggtggtcgtggtggctatggccgtagaggtggttacggtggtggccgtggtggttacggcggtaacaggcagagagatggtggctggggtaacagaggtcgttcaaactattga

SEQ ID NO: 328 - protein, 546 aa, Saccharomyces cerevisiae
MTYGGRDQQYNKTNYKSRGGDFRGGRNSDRNSYNDRPQGGNYRGGFGGRSNYNQPQELIKPNWDEELPKLPTFEKNFYVEHESVRDRSDSEIAQFRKENEMTISGHDIPKPITTFDEAGFPDYVLNEVKAEGFDKPTGIQCQGWPMALSGRDMVGIAATGSGKTLSYCLPGIVHINAQPLLAPGDGPIVLVLAPTRELAVQIQTECSKFGHSSRIRNTCVYGGVPKSQQIRDLSRGSEIVIATPGRLIDMLEIGKTNLKRVTYLVLDEADRMLDMGFEPQIRKIVDQIRPDRQTLMWSATWPKEVKQLAADYLNDPIQVQVGSLELSASHNITQIVEVVSDFEKRDRLNKYLETASQDNEYKTLIFASTKRMCDDITKYLREDGWPALAIHGDKDQRERDWVLQEFRNGRSPIMVATDVAARGIDVKGINYVINYDMPGNIEDYVHRIGRTGRAGATGTAISFFTEQNKGLGAKLISIMREANQNIPPELLKYDRRSYGGGHPRYGGGRGGRGGYGRRGGYGGGRGGYGGNRQRDGGWGNRGRSNY

SEQ ID NO: 329 - DNA, 959 bp, Saccharomyces cerevisiae
caaaaagagctaatcaactccttgaacttagataaatacgccataaatgataacagtgaggaatgggctgaatctcaaaaatctttagaaatagctgccaaggccaaaggcgtcgtcagtttaaaaactggtaaaaagagaacgactgaaaaggctgaagatatctatagacaagagatgaaagctatgaaaaaaccaagaaagtctaaaaaggctgcaaattaagcgttctactctttgtcaaacccttttatagctaaacgtttacttaatttgtacaataatatagaatagaaacatagttgatgtttgaacctttacatattcctttcaatcgtgtcgagcgatataagtattacgattatgccggcgaaaactgaacccgttttagacaatttcaatcaacatactccactccgtagtgagtaacttttggagtaatacgaagtaaccaaagaggtcaaaacggaactatataccccaaaataagcatcattcaaatggtcgaattaactgaaattaaagacgatgtcgttcaattagacgaaccacaattttccagaaatcaggccatcgtggaagaaaaggcttctgcaacaaacaacgacgttgtcgatgatgaagatgactctgatagtgattttgaagatgaatttgatgaaaatgaaacattgttggacagaatcgttgctttaaaagacattgtccccccaggtaagagacaaacaatttctaatttttttggttttactagctcttttgtgagaaatgctttcacaaaatccggaaaccttgcttggactttgaccaccactgctttgttactcggtgtgccactatccttatctatacttgccgaacaacagctaatcgaaatggaaaagacatttgatttacaaagtgatgctaataacatattggcccaaggtgaaaaagatgctgcagcaacagccaattaa

SEQ ID NO: 330 - protein, 152 aa, Saccharomyces cerevisiae [sequence omitted]

SEQ ID NO: 331 - DNA, 1631 bp, Saccharomyces cerevisiae
aaactcggaaactctttttctattcatcttcccttctcgtacgtgcccacggaagcaataaaaagaaccgaaataaccaacacccgtaacgtcaaagcattcatgcttagaatggaaaccatttcgtggaatgaaatggcaaattgatcacattgattgctcgttccactacctgtgtccgcaattttttaatggtcatcacagcccctgctgactaaagttcctcggatccgcttacggttgtcgcgcggttccgcccctgcgtactcttagtacctagcatatgggctccctccgttggattggcatcgattagtaaggacagatgttaaggatttaagaccgtttttaaggtatttcggcaatgcttcgatttaaaaggagagagttttttttttgccgttttcttcctctcacttcttgattagtactgtaattctagttgaaaaaaaatcgttaactatacacagcaaaaagcaatatcatactgcatatcaagcatgtccgcctcgattccagaaaccatgaaagccgttgtcattgaaaatggcaaggctgtagtcaaacaggacattccaattcctgaattagaagaaggatttgttctaattaagactgtcgccgttgccggtaaccctaccgattggaaacatattgatttcaagattggtcctcaaggtgccctcttaggctgtgatgcagccggccaaatcgtaaagttgggcccaaatgttgatgctgcacgctttgccattggtgattacatttatggggttattcacggtgcttcagtgaggttcccctcaaacggtgcctttgctgagtactctgccatttcatccgagactgcttataaaccagccagagagtttagattgtgcggtaaagacaagctaccagaaggccccgtaaaatctttagaaggggcagtatccctcccagtctcattgaccacggctggtatgatccttacacatagttttggcttggacatgacatggaagccctccaaagcgcaaagagatcaacccatcttattttggggtggtgccactgctgttggccagatgcttattcaattggcaaaaaaactaaacggtttcagcaagatcatcgtcgttgcttctcgtaaacatgaaaaattgttgaaagagtacggtgcagatgaactttttgactaccacgatgctgacgttatcgaacagataaaaaagaagtacaacaacattccttacttggtggactgtgtctccaacacagaaactattcaacaggtgtacaaatgtgccgctgatgacttagacgctacggtcgttcaattgaccgttttaaccgaaaaagatatcaaggaggaagacaggaggcaaaacgtcagtattgaaggaacccttctatatttgataggaggtaacgacgtcccatttggcacgtttactttgccagcagaccctgaatacaaggaagccgccataaaatttattaagttcatcaatccaaaaatcaatgatggtgaaatccaccacatcccagtgaaagtttacaagaacgggttagatgatatcccacagttacttgatgatattaagcacgggaggaattctggcgaaaagttggttgccgtcttgaaataa

SEQ ID NO: 332 - protein, 376 aa, Saccharomyces cerevisiae
MSASIPETMKAVVIENGKAVVKQDIPIPELEEGFVLIKTVAVAGNPTDWKHIDFKIGPQGALLGCDAAGQIVKLGPNVDAARFAIGDYIYGVIHGASVRFPSNGAFAEYSAISSETAYKPAREFRLCGKDKLPEGPVKSLEGAVSLPVSLTTAGMILTHSFGLDMTWKPSKAQRDQPILFWGGATAVGQMLIQLAKKLNGFSKIIVVASRKHEKLLKEYGADELFDYHDADVIEQIKKKYNNIPYLVDCVSNTETIQQVYKCAADDLDATVVQLTVLTEKDIKEEDRRQNVSIEGTLLYLIGGNDVPFGTFTLPADPEYKEAAIKFIKFINPKINDGEIHHIPVKVYKNGLDDIPQLLDDIKHGRNSGEKLVAVLK

SEQ ID NO: 333 - DNA, 893 bp, Saccharomyces cerevisiae
gaaaatacacacggcggaagccatcatcgaggcccaaagcaaggataaagcatgctttttcctggataaaccagaatataataaaccgatacctgggaccataatccacacacctgctgaagccacaccgatccatcccatgttggccaagtcaaattgtgtattcaaatctgttgtcaacgagttaccacccgttccttcgcctgtaggcgtacctgtaaaattgtaagacattgttgatattgtattgtaatatattaagtatgatatattacaaaactaaacttctttcaaagctctgtgcagacttattatttaagaaggatatttaatttgaaaggacgtgaaagcacgaatgattactacccactgatgtttggttagcacatgtgtaactactgcttatatatggtgcagaaaagtggctcggaatgaacacctcttgtactgaatacttcattgataaggcacagggtcttcacgccgcttagtattcgtcgatgcgtgagcaattgaagctttttacgagggaaatagtcgattttacatttcttatcttatctggctttgactattaccagacactcttgataagcagtaacagcagtaagaagagaccgaaggattcttctttgttatcggaaaaaaaaaaaaaaaaaaaaaaaaaaaaaaaagatgtcttatcttatctttcttatcttaaagacctaccatttgttccttttctattttggcagcccgggtattcgcaaagggaaaaaaacccaagacagcattccttgttcattatgactattacaaagccaggaatgatttcgatggccgacatgaattacgtcgtttccaagaacagaagcttaaaccgtcctgctgagcggggcggtaatcggtga

SEQ ID NO: 334 - protein, 130 aa, Saccharomyces cerevisiae
MREQLKLFTREIVDFTFLILSGFDYYQTLLISSNSSKKRPKDSSLLSEKKKKKKKKKKDVLSYLSYLKDLPFVPFLFWQPGYSQREKNPRQHSLFIMTITKPGMISMADMNYVVSKNRSLNRPAERGGNR

SEQ ID NO: 335 - DNA, 938 bp, Saccharomyces cerevisiae
acagcggttaatttcaaataccctaatcggaggtcttatcttatttttcaagggcaaggctctccacatcggtaagtgatgaccagataatggaaagtagcagaattttatttatgtgccatacaagcccggagaaacagagtagctaaaaaattaaggtgtgcaaaagtggttttgttccccgacgcccgggcctttctctcccctgaatcttttcgttccggcccccctctctcaataccagatctgcatctatactaaagctgcagtgagagtaaaccggaaaattatcctgcgtgtttgcttcggtcttagcttttacttgggtatgcgagaacctctaagagcttagaccggtcttcctccctaaaaagaaaattataaaaggttattatctggactaaagcaaaaaaaaaacaacgtttcggcgtccgctcaaaattttcattacgcttcttggtcaaatcagttacgtaacgggttatgacgaatacgatgagatgagtaattgcagaaggctcctatgcagacagctaagcagtgcttacttgaattaccttcccttttatttcttgatatatcgtcctttttctctctatcttagttcttgcgagtactggcaatcatgtttctcctttttttttcttttttttttattttttttttttttttttacttttcagtttctcgtagcttttcctattttgctatttaaagtaagtttaaatagtaccctcactaaacacgtacggccgatccaccaacgaacaaaagcacgatccttgacccatcattgtattccaaagcgttggaacattcacttttttttttccggtctattgcacaagacaatatccagaatattcagttggataggaaatacaagacaggtggcacccacaaagcacacgccgaaatatttattaaatacaatatag

SEQ ID NO: 336 - protein, 145 aa, Saccharomyces cerevisiae
MSNCRRLLCRQLSSAYLNYLPFYFLIYRPFSLYLSSCEYWQSCFSFFFLFFLFFFFFFTFQFLVAFPILLFKVSLNSTLTKHVRPIHQRTKARSLTHHCIPKRWNIHFFFSGLLHKTISRIFSWIGNTRQVAPTKHTPKYLLNTI

SEQ ID NO: 337 - DNA, 659 bp, Saccharomyces cerevisiae
taaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacccacacccacacccacacaccacacccacacacccacaccacacccacacccacacacccacacccacacccatcacaaccctaaccctaccctattctaa

SEQ ID NO: 338 - protein, 52 aa, Saccharomyces cerevisiae
MSLRPCLTPSSMQYSDIYIPTPTPTHHTHTPTPHPHPHTHTHTHHNPNPTLF

SEQ ID NO: 339 - DNA, 1349 bp, Saccharomyces cerevisiae
atggacaatttgaagttcttgactacccctatctcacactagtacgtaattcaatgtatcattcgtattgtaagtagatagagacgcaatacaggaaagctgaccttccttccaatcaccacggctgaaatgctttgttgaccaattacggacgcttaagagcggacgcggctggaacggctccatcctaaatcggcggagggagaactccgataccagccgacatggcaataatagtgacagtagatgctaccagccccgcaataatttcacagtagatcatcaacagtctcctcatttctggaaatgatcagcaacttcgacggatttaactctcaagcagttacgcactccgagaacagccgtgatcatctttgaacaagcaaaatatataaagcaggagaactgtcctacctagagctagaatagccataactaactatgtaacattctacagatcaatcaaaaacaatcttcaatcacagaaaaaaataaaaggcatgtctgacagagaacaaagcagcggcaacaccgcttttgagaaccctaaggcactcgattcttccgagggtgagttcatctctgaaaacaacgatcagagccgccactcgcaagagtccatatgcaaaatatatactgcgggcaaaaacaacgagtatatttacatcggccgtcaaaaatttttaagggatgatttgttcgaggcattcggtggtactctgaatcccggtttagcccccgcgccagtccataaattcgcaaatcctgctccactaggactttccggttttgccctcactacgtttgtcctatccatgttcaatgcaagagcccaaggcatcactatccctaatgttgttgttgggtgtgccatgttttacggtggcctcgttcaactcattgctggtatttgggaaatcgctttagagaacactttcggtggtacagccctgtgttccttcggcggtttttggttaagcttcggtgctatatacatcccttggtttggaattctagatgcctataaggacaaggaatccgaccttggaaatgcgctagggttttacctcctaggatgggcactcttcaccttcggtctttccgtctgcaccatgaaatcaactataatgttttttgccttattcttcctcttagcagtgaccttcttacttctatccattgcaaacttcacaggcgaagttggcgtcactagagctggtggggtccttggtgtgatagtagccttcattgcctggtacaacgcttacgcaggtattgccacaagacaaaactcgtacattatggtccatccattcgcattacctagcaatgataaggtgttcttctaa

SEQ ID NO: 340 - protein, 282 aa, Saccharomyces cerevisiae
MSDREQSSGNTAFENPKALDSSEGEFISENNDQSRHSQESICKIYTAGKNNEYIYIGRQKFLRDDLFEAFGGTLNPGLAPAPVHKFANPAPLGLSGFALTTFVLSMFNARAQGITIPNVVVGCAMFYGGLVQLIAGIWEIALENTFGGTALCSFGGFWLSFGAIYIPWFGILDAYKDKESDLGNALGFYLLGWALFTFGLSVCTMKSTIMFFALFFLLAVTFLLLSIANFTGEVGVTRAGGVLGVIVAFIAWYNAYAGIATRQNSYIMVHPFALPSNDKVFF

SEQ ID NO: 341 - DNA, 854 bp, Saccharomyces cerevisiae
atatggtttcatcattttgctcaattgttctccatttgggttaccttttttgccagttggtcgtacttgaggtttttccagaaacttgcacccttgaattgtccctctttgccaacaactaattctcaaggtggtcaggaaatattggtcggcgatgcatctgatacttttcaattgatttacttctttcctgatctaattaagccgattttgaggccgattttcaatttcatttataatgtagttgttgtaaaatttaaagtcattaaaccttttcatgatattgatatagatattgggaacaccatcgcagaaagtagaggcgccaaaaaaattatgactgtagaagaaagacgaagacagttagctttacaagttttggaagagcgtatggtaaacccttgatatatggatctatataacttgaaatatgctctattatatcgtgatttaatgacggctgttggcatttcggtctttaccaaggtagtaggatttgtatgctgaatgtgcgccagtactatcgaaccatagaaacccatatattccccaatattaataattctactgagaaatgggtgaattttgaaataattgttgggattccatcgttgataaaggctataatattaggtatacagaatgtactagaagttctcctcgatgatataggaatccccataatggaatctatatttctatgtaccaatattacgattattcctcattccatttcatatgtttcattatcctattacattatcgatccttgcatttcagcttcctctaacttcggtgacagcttctataataacttatgtcactatctaacaccgtatatgataatatattga

SEQ ID NO: 342 - protein, 117 aa, Saccharomyces cerevisiae
MLNVRQYYRTIETHIFPNINNSTEKWVNFEIIVGIPSLIKAIILGIQNVLEVLLDDIGIPIMESIFLCTNITIIPHSISYVSLSYYIIDPCISASSNFGDSFYNNLCHYLTPYMIIY

SEQ ID NO: 343 - DNA, 842 bp, Saccharomyces cerevisiae
ggaggtctgcttcacgagcgcggtgtgcgcctagtattgccccgacggtccgggtgcctatccctagatttcgtcgtgccccgacccaaatagttaaacgtgtggtttatgggtgcaccagggctttatcgtgttttatatcgatggcgatttgtgcctccagtgtatttttgtatatccaattaaggtttcttacctaattttatttttatcatctttagttaatgctggtttgctctgtttctgctgctttctgtgcggttctcctcttctcttgtttcttcgtgttgtcccccatcgccgatgggcttatatggcgtatatatatagagcgagtttttacgtcgaagatcatctcagtttgcttgatagcctttctactttattactttcgtttttaacctcattatactttagttttctttgatcggtttttttctctgtatacttaaaagttcaaatcaaagaaacatacaaaactacgtttatatcaattaataatgtctgaaattcaaaacaaagctgaaactgccgcccaagatgtccaacaaaagttggaagaaaccaaagaatctttgcaaaacaagggccaagaagtaaaggaacaagctgaagcttctatcgacaacctaaaaaatgaagctactccagaagctgaacaggtgaagaaggaagaacaaaacattgctgatggtgtcgaacaaaagaagaccgaagctgccaacaaagttgaagaaactaagaagcaagcttccgccgccgtcagtgagaagaaggaaaccaagaaggaaggcggtttcttgaagaaattgaaccgtaaaattgcttccattttcaactaa

SEQ ID NO: 344 - protein, 113 aa, Saccharomyces cerevisiae
MSEIQNKAETAAQDVQQKLEETKESLQNKGQEVKEQAEASIDNLKNEATPEAEQVKKEEQNIADGVEQKKTEAANKVEETKKQASAAVSEKKETKKEGGFLKKLNRKIASIFN

SEQ ID NO: 345 - DNA, 1772 bp, Saccharomyces cerevisiae
atcccctcatacttttccgtttgtatctcctactttcttacttcctttttttcttctttatttgcttggtttaccattgaagtccatttttactacagacaatagctagtcattcgctatcttccgtttgtcactttttttcaaatttctcatctatatagcgaagtacggaaaagatgtcacttgccggcatctcggccttccccggccaaatggactcatcatctacgatacggcccctttaatccgcaattactttgcccattcggccgtagccgttctaaagccgccgtgccttgcccccaatactcccctaatgatccgggaagttccggtttttttcctttgtttagtggcattttgtgttgcccaaggttgggaaggtccgatttgactttaaggaactacggaaggtatctaaggtttctaaaaacaatatacacgcgcgtgcgtagatatataaagataaagatttatcgatatgagataaagattgctgcatgattctccttctgattctttttccctgtatatattttctccccttctgtataaatcgtacagtcagaagtagtccagaatatagtgctgcagactattacaaaagttcaatacaatatcataaaagttatagtaacatgcctcactcagttacaccatccatagaacaagattcgttaaaaattgccattttaggtgctgccggtggtatcgggcagtcgttatcgctgcttttgaaagctcagttgcaataccagttaaaggagagcaaccggagcgttacccacattcatctggctctttacgatgtcaaccaagaagccatcaacggtgttaccgccgacttgtctcatatagacacccccatttccgtgtcgagccactctcctgcaggtggcattgagaactgtttgcataacgcttctattgttgtcattcctgcaggtgttccaagaaaacctggcatgactcgtgatgacttatttaacgtgaatgctggtatcattagccagctcggtgattctattgcagaatgttgtgatctttccaaggtcttcgttcttgtcatttccaaccctgttaattctttagtcccagtgatggtttctaacattcttaagaaccatcctcagtctagaaattccggcattgaaagaaggatcatgggtgtcaccaagctcgacattgtcagagcgtccacttttctacgtgagataaacattgagtcagggctaactcctcgtgttaactccatgcctgacgtccctgtaattggcgggcattctggcgagactattattccgttgttttcacagtcaaacttcctatcgagattaaatgaggatcaattgaaatatttaatacatagagtccaatacggtggtgatgaagtggtcaaggccaagaacggtaaaggtagtgctaccttatcgatggcccatgccggttataagtgtgttgtccaatttgtttctttgttattgggtaacattgagcagatccatggaacctactatgtgccattaaaagatgcgaacaacttccccattgctcctggggcagatcaattattgcctctggtggacggtgcagactactttgccataccattaactattactacaaagggtgtttcctatgtggattatgacatcgttaataggatgaacgacatggaacgcaaccaaatgttgccaatttgcgtctcccagttaaagaaaaatatcgataagggcttggaattcgttgcatcgagatctgcatcatcttaa

SEQ ID NO: 346 - protein, 423 aa, Saccharomyces cerevisiae
MILLLILFPCIYFLPFCINRTVRSSPEYSAADYYKSSIQYHKSYSNMPHSVTPSIEQDSLKIAILGAAGGIGQSLSLLLKAQLQYQLKESNRSVTHIHLALYDVNQEAINGVTADLSHIDTPISVSSHSPAGGIENCLHNASIVVIPAGVPRKPGMTRDDLFNVNAGIISQLGDSIAECCDLSKVFVLVISNPVNSLVPVMVSNILKNHPQSRNSGIERRIMGVTKLDIVRASTFLREINIESGLTPRVNSMPDVPVIGGHSGETIIPLFSQSNFLSRLNEDQLKYLIHRVQYGGDEVVKAKNGKGSATLSMAHAGYKCVVQFVSLLLGNIEQIHGTYYVPLKDANNFPIAPGADQLLPLVDGADYFAIPLTITTKGVSYVDYDIVNRMNDMERNQMLPICVSQLKKNIDKGLEFVASRSASS

SEQ ID NO: 347 - DNA, 1142 bp, Saccharomyces cerevisiae
acaagtttggatactggtattgtgactcttgtaagaagaagaatacatcttgtgttctatgtgaaagaccattaaagaaactgaccatggtcatcctcccctgtggacacgaaggtcacttccagtgcatacaagaatggtttctcgatgagaatgaacaagaatgtcccggcggttgccccggtgttgcattcatctaggttctccacataatgtatagtttaacatatcatcaccattgtttagttaaatcgtttagagtaatattacccgtcaaaaaggtcgggtaaaattttattaccctctccgaaaagaaaatttttttcgtcgtcaatagagtttaatgcaatacctgataaagagagttttacattgcaagaggtagtgttaattctggatttatattgtacatatgtgtttgtgttagtgcttgagtacttcctaggagttttacgaaaaataaaagcatttttgtctgaaaactagtgaaaggaagaaaaatgtccgttgaagaagttagcaagaagtttgaagaaaacgtttcagtcgatgataccacagctactccaaagactgttttaagtgacagtgctcacttcgatgtcaagcacccattgaacaccaaatggactttatggtacacaaagccagccgtcgataaatctgagtcgtggtctgatctattacgtcccgtcacttcattccaaactgttgaagaattttgggctatcattcaaaatattcctgagccacacgaactaccattgaaatcagattaccacgtcttccgtaatgacgttagacctgaatgggaagatgaagccaatgctaaaggtggtaaatggtctttccaacttagaggaaaaggtgctgatattgatgaattatggctaagaactttactagcagttattggtgaaacaattgatgaagacgactcccaaattaacggtgtcgttttaagcattagaaaaggtggtaacaagtttgccttatggactaaatctgaagacaaagaaccactattgagaattggtggtaaattcaagcaagttttaaaattaaccgatgacgggcatttggaattctttccacattccagtgccaatggtagacaccctcaaccatcaatcaccttgtaa

SEQ ID NO: 348 - protein, 213 aa, Saccharomyces cerevisiae
MSVEEVSKKFEENVSVDDTTATPKTVLSDSAHFDVKHPLNTKWTLWYTKPAVDKSESWSDLLRPVTSFQTVEEFWAIIQNIPEPHELPLKSDYHVFRNDVRPEWEDEANAKGGKWSFQLRGKGADIDELWLRTLLAVIGETIDEDDSQINGVVLSIRKGGNKFALWTKSEDKEPLLRIGGKFKQVLKLTDDGHLEFFPHSSANGRHPQPSITL

SEQ ID NO: 349 - DNA, 812 bp, Saccharomyces cerevisiae
ttcccatttccactgctattcctgttgctattgtcagaaccattgtttacttgaatgttattactaccattttgtgaatcaaaaatatctacttcttgtggggagacgggtagaagatttgtattttgcgagacgtctctcaaatatatggccaaaacaccttgatattctagtttattccattcgtccttcttgaagtcccatttatacagtgacgcatgtggtgtgtgaaaaagtagttgctttatttttggatcgtatctcccaataacgttgaaattcaaagcttttctatagaattctaactgtgtggcagagttttctgctgcagttgctgctccggtcattgtgcacagcttttcttgtgatgtgttgcaaagataaatgcttatctgaacgtttctctattgttttttcgtcaattttcttttctttcttgcttcgcgttttcgacatattaagctgtatatagaagagaaaaatgcgcagagatgtactagatgataaaaaataattgtaataacgttaatatatataaatattatctattttcatttaaagtttatattctgccctcaaattttaaaatttgggaggcagtgtcgtcaatggtctctttcaagttcctgaacttgaaacctaacaatttcttactctttttattatcaagagtagcaccaagggtgttatgggtagcaccagaacctggtttccccactggaatattgccttttagaacagggaagtcttcgttaaggatatcgagaacatcctgcatagtaaatctggcctccgatacgattagtctttga

SEQ ID NO: 350 - protein, 103 aa, Saccharomyces cerevisiae
MIKNNCNNVNIYKYYLFSFKVYILPSNFKIWEAVSSMVSFKFLNLKPNNFLLFLLSRVAPRVLWVAPEPGFPTGILPFRTGKSSLRISRTSCIVNLASDTISL

SEQ ID NO: 351 - DNA, 1529 bp, Saccharomyces cerevisiae
gcgtgaactatgtcatatttgcgattttaggtacaataaatattatcattattatattatgtttgcatgtaggttctacaaatacattgttgtacgctatagtttcctttcaaaactagaaagaattcgtaacaaaataatctccaatattttatagcaccttattaatatcaatgctgcaataccttctcatttcaacaattggccctcacctcttttgtacaaaaaacgtcgccattgataaaataagtaagaagcatataattggaatgtccattacgtaaaagaaaaaaaatcatgtgtacatattacgtaatagaatacggaattttctcgcggaagtagatcttccgtggaaaaaaaggaaaaagtccgatcaatattgaaaaagggatccttagtttcccaactatataaggaggaaaagtctatctctgtagcgttgatataacgtgtacgattttcaaacaaacagatagcagtatcacacgcccgtaaatatgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataa

SEQ ID NO: 352 - protein, 342 aa, Saccharomyces cerevisiae
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 353 - DNA, 1439 bp, Saccharomyces cerevisiae
tgtcttacatattgcaatggatatgcttgggtgatcatacttcctggctttagatatttgaaacttaactcttgtcaacaaacttcctatggagtgtataagaattgtaagttataacaccggcgaacaatcggggcagactattccggggaagaacaaggaagggcggtcttttctccctcattgtcatagcaaggtcatttcgccttctcagaaaggggtagaatcaatctagcacgcagattgcaaacacggcttaataatatgcctatcaggcattcacccgtgtgacgaatcgcacaccgctgctctccttaattccctagagtagaaaccgagctttcaggaaaagactacggcagtaaagaattgctttactgggcgtataaaaccgggagaatcaagacattctaatgacttgattcaggatgagagcttaataggtgcatcttagcaagctaaaatttggacagctctcattactaaattaagatagaaaaatgcctgctactttacatgattctacgaaaatcctttctctaaatactggagcccaaatccctcaaataggtttaggtacgtggcagtcgaaagagaacgatgcttataaggctgttttaaccgctttgaaagatggctaccgacacattgatactgctgctatttaccgtaatgaagaccaagtcggtcaagccatcaaggattcaggtgttcctcgggaagaaatctttgttactacaaagttatggtgtacacaacaccacgaacctgaagtagcgctggatcaatcactaaagaggttaggattggactacgtagacttatatttgatgcattggcctgccagattagatccagcctacatcaaaaatgaagacatcttgagtgtgccaacaaagaaggatggttctcgtgcagtggatatcaccaattggaatttcatcaaaacctgggaattaatgcaggaactaccaaagactggtaaaactaaggccgttggagtctccaacttttctataaataacctgaaagatctattagcatctcaaggtaataagcttacgccagctgctaaccaagtcgaaatacatccattactacctcaagacgaattgattaatttttgtaaaagtaaaggcattgtggttgaagcttattctccgttaggtagtaccgatgctccactattgaaggaaccggttatccttgaaattgcgaagaaaaataacgttcaacccggacacgttgttattagctggcacgtccaaagaggttatgttgtcttgccaaaatctgtgaatcccgatcgaatcaaaacgaacaggaaaatatttactttgtctactgaggactttgaagctatcaataacatatcgaaggaaaagggcgaaaaaagggttgtacatccaaattggtctcctttcgaagtattcaagtaa

SEQ ID NO: 354 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 355 - DNA, 806 bp, Saccharomyces cerevisiae
ggtgacgctgtttgggctacttctggtggcctatctttgcaaccaaacgaaattggtgaaattgttcaaggcttcgacaatccagctggtttgcaaagcaatggtttgcatattcaaggccaaaagttcatgttgttgagagctgacgatagaagtatctacggtagacatgatgctgagggtgttgtttgtgtaagaactaagcaaaccgttattattgctcattatccaccaaccgtacaagccggtgaggccaccaagattgtcgagcaattggctgactacttgattggtgttcaatactaatttatgcaggtaaagttttcttgccttatacaccacctattctggcatctgcgggatttcgcttcctattttacaaatattttattgattgacgctaattatcactgtaaaaggcgcactttttatatgtagtcacatccggtatttaacatatttacgaaacagtcttaagaatatcgacatttgatatacttatgtttaatttatctacatattacaatcatacgagaaacacgcaaaaacaattacttgaatacttcgaaaggagaccaatttggatgtacaacccttttttcgcccttttccttcgatatgttattgatagcttcaaagtcctcagtagacaaagtaaatattttcctgttcgttttgattcgatcgggattcacagattttggcaagacaacataacctctttggacgtgccagctaataacaacgtgtccgggttgaacgttatttttcttcgcaatttcaaggataaccggttccttcaatag

SEQ ID NO: 356 - protein, 101 aa, Saccharomyces cerevisiae
MFNLSTYYNHTRNTQKQLLEYFERRPIWMYNPFFALFLRYVIDSFKVLSRQSKYFPVRFDSIGIHRFWQDNITSLDVPANNNVSGLNVIFLRNFKDNRFLQ

SEQ ID NO: 357 - DNA, 1090 bp, Saccharomyces cerevisiae
aggaagaggaggctgcgtttgacgacgaagaggatgataatgaggaagaagaagaagaagaggacgcggatgaagagaacgcctctcgtctaagaaatttaaaaagagaaggagcagcaatgtacagagaagaggaagaagaagaaaaagataggagcgagacaaaaagaagaagggttgcggtcatcgaggacgacgaagacgaggattagaggagacgttactttgtttatatatattagtatgtacaatcgcaaagaaatggagtgatgacatgttgtagtatttagtatgaggttactgtgtgggaggttttaccatgatttttggcgagaacacgccatgaaatgtctttgtacgaaactcattacccgcattaatattttttttctttttaaagctcagttgaccctttctcattcccttcttaaaacaactgtgtgatccttgagaaaagataaattacatacacaacataaacccaactacgatcgcaaattatgtcttggcaaggtatgtgaacgagacaattatcaattgattaagaaagaaatgagtcggaggttagcttgtgtgacaatgtttggcaatgcccgatttttgttgatgcgcgtaatttcgaagattaaccactcagagtaaattactaactggaatatcaaaaaacatatgaaatttcaaacatgaatttctttccgtttttttctcctacttttaaacagcatacactgataacttaataggaaccggtaaagtcgacaaagctgtcatctactcgagagcaggtgacgctgtttgggctacttctggtggcctatctttgcaaccaaacgaaattggtgaaattgttcaaggcttcgacaatccagctggtttgcaaagcaatggtttgcatattcaaggccaaaagttcatgttgttgagagctgacgatagaagtatctacggtagacatgatgctgagggtgttgtttgtgtaagaactaagcaaaccgttattattgctcattatccaccaaccgtacaagccggtgaggccaccaagattgtcgagcaattggctgactacttgattggtgttcaatactaa

SEQ ID NO: 358 - protein, 126 aa, Saccharomyces cerevisiae
MSWQAYTDNLIGTGKVDKAVIYSRAGDAVWATSGGLSLQPNEIGEIVQGFDNPAGLQSNGLHIQGQKFMLLRADDRSIYGRHDAEGVVCVRTKQTVIIAHYPPTVQAGEATKIVEQLADYLIGVQY

SEQ ID NO: 359 - DNA, 1157 bp, Saccharomyces cerevisiae
tcctgaacggaagctgcagtttgctcagtacctacacgctcctctgacatagaagatgatccatctgtggttgttgcagcaggttcagaatcttcctcctggggctcagcaaatggattgttatccagatcatcatatggatcataaggtacagccgaagtcattgttcagaggatagatggattgactaagggtacagtacggcaaaaaaaaattagatcagcttttcaaaacaaactattttggcgtttaccaaaaccaaaacagtatattcaactagttcaatcactcttgaaaacgtcccctttctacaaaattaggctttgaacgcgtgctatggaaaaaagtgtaaagaaaacgaaaaaaccagaaaagtcatatatatcttataacgaaatatcagggtgttcgactcaatcgccaggtgccgctaacacaatcattaggatagtcgggcaatatatacggttcaatagtcactgaaagtgtatcacagaataatgacaaagctacaaggactacagggattaaaacacatcaaagcggttgtatttgatatggatggcacattatgcctaccccagccttggatgtttccagcaatgagaaacgccataggattggaggacaaatcgattgatatccttcatttcattgatacattgcccacagaaaaagaaaaaaaagaagcgcatgatagaatagaattagttgaggcaaaagccatgaaggagatgcaaccgcagcctggtctggttgacataatgaggtatttgacgaaaaatggtattagcaagaacatatgtactagaaatgtcggagccccggtagagacttttgttaaaagatttattccatccgagctttcgaggtttgactatattgtgacaagggagtttaggcctacaaaaccgcaaccagacccattattacacatcgcctcgaagctaaatataaggcccttggaaatgatcatggtaggagattcatttgacgacatgaaatccggtagatctgctggatgtttcacggtattactcaagaatcatgtgaatggacatttactgctcgaacataaagaactagtagacgtttcagtagaggatctttccgaaataattgaattgattcaaaatatgaataaagaaagtttctaa

SEQ ID NO: 360 - protein, 218 aa, Saccharomyces cerevisiae
MTKLQGLQGLKHIKAVVFDMDGTLCLPQPWMFPAMRNAIGLEDKSIDILHFIDTLPTEKEKKEAHDRIELVEAKAMKEMQPQPGLVDIMRYLTKNGISKNICTRNVGAPVETFVKRFIPSELSRFDYIVTREFRPTKPQPDPLLHIASKLNIRPLEMIMVGDSFDDMKSGRSAGCFTVLLKNHVNGHLLLEHKELVDVSVEDLSEIIELIQNMNKESF

SEQ ID NO: 361 - DNA, 1517 bp, Saccharomyces cerevisiae
gtaaggtaaggcatcattagcaggatccatattcactacctgggaatgtcttccgatggcattgaagaactgtgagcagccgttgcaataggttgacttccctgaacctggtggaccaataacaatctgagcgaagggcattattgtactctctagtagaaaatcaaaactattgacacaacaacaatcaaatgaaaacaaaccattctattacggtaagtagtgaagactcacaatgcaatctttcaatgagcatcacttactttaagtagcaatattcctaatcacttattacgaaatttgattttactaaagttcggggatacctcagtggcaaatcgttactcaagttgcacgtaacgtagaatctacaatgaaataattgtgaagccaacagctaagcaatctatagtgtaacgttggctttctgtacaactgctactgattgagggcatttttcgaatttaaaaaagaaagaaagaaaggaaaatcaaattacaatgtctctacaacacgagaaagttaccattgcaccactagttttgctatctgctttggatcattatgagcgtacgcagacaaaagaaaacaaaagatgcgttggtgtcatcttaggtgatgctaacagttccactatcagagtcactaattcctttgccttaccgtttgaagaagatgagaaaaactctgacgtgtggtttttagaccataattatattgaaaacatgaatgaaatgtgtaaaaagattaatgccaaggaaaaactcattggatggtatcatagtggtcctaaattaagggcttctgacctcaagattaatgagctgtttaaaaaatatactcagaataatccgctattattaattgttgatgtcaaacaacaaggtgttggtttaccaacagatgcatatgtcgcgattgagcaagttaaggatgatggtacgtctacagaaaagacgtttcttcatttgccttgtactattgaggccgaagaagctgaagaaattggtgtagaacacttattgagagacgtacgtgatcaagcagcaggtggcttatctatccggttgaccaaccaattaaaatctttgaaaggattacaaagcaaactaaaagacgttgtcgagtacttagacaaagtcattaataaggaattaccgataaaccacactatattgggcaagctacaagatgttttcaaccttttaccaaatctgggaacacctgatgatgacgaaatagatgtggagaatcatgacagaattaatatttcaaataacttacaaaaggctttaactgtgaaaactaatgatgaattaatggttatatatataagcaatttggttaggtcaattatcgcgtttgatgatttgattgaaaacaaaattcaaaataaaaaaattcaagaacaaagagtaaaggacaaacaatcaaaagtctctgatgacagtgagagtgagagtggtgacaaagaagcaactgcgccattgatccaacgaaagaacaagaaaaattaa

SEQ ID NO: 362 - protein, 338 aa, Saccharomyces cerevisiae
MSLQHEKVTIAPLVLLSALDHYERTQTKENKRCVGVILGDANSSTIRVTNSFALPFEEDEKNSDVWFLDHNYIENMNEMCKKINAKEKLIGWYHSGPKLRASDLKINELFKKYTQNNPLLLIVDVKQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMVIYISNLVRSIIAFDDLIENKIQNKKIQEQRVKDKQSKVSDDSESESGDKEATAPLIQRKNKKN

SEQ ID NO: 363 - DNA, 2780 bp, Saccharomyces cerevisiae
tagttctatttggctatatatttcagagtgacaaatctttaagagagacaaactgagaattagcatatagaatcattcatacaactgtttacaaacaagtaagcccaagacagttcccaaccgcttaaagaagtttttcctagagggagcaaagttcgtttacatttcacacacacagttttttttcacttttttgggcctcttccttttcccgtttttttcaaaaagcttagaaatcttcttcacctcctatttttctagaatcgtgaagaatttccagatttaacagttttccactttttcaataaggaaatagtaggaataataaaaaaaggatagtagtaacgatatacgtcgactttccagactggtctcgagccggaattaaatacaatagcagcgtttgactaccacattgtagctccgctagaattgatcgaaaacaaaaataataacactaataattataataatacggtagaactatttctcgtataaagatgcctaatctattgtcgagaaacccattccatggtcatcataatgaccatcatcatgaccgtgaaaattcgtctaataacccgccacagttgatcagaagttctaaatctttcttaaacttcattggtagaaaacaaagtaatgactcactaagaagcgagaaatctacagattccatgaaatctaccacaaccactacaaattatactacaacaaaccttaataacaacacccatagccattctaatgcaaccagtatctcaacaaacaactacaataataactatgaaacaaaccaccaccataatatttctcatgggctccatgactatacttctcccgcctctccaaaacaaacccactccatggcagaattgaaaaggtttttcagaccttctgtaaataaaaaactatctatgtctcaacttcgttccaagaaacatagcacccattcccccccaccttcaaaatcaacttctacagttaatttaaataatcactatcgtgcccagcatcctcatggctttacagaccactatgctcatacccagtctgctataccgccaagtaccgattctatcctatctttgtccaataatattaatatatatcacgatgattgtattctggctcaaaaatacgggaaattgggtaagttattgggttccggtgccggtgggtccgttaaagttcttgtgagaccaactgatggtgctacttttgccgtcaaagaattcagaccaaggaaaccgaatgagagtgtgaaagaatatgccaagaagtgcaccgcagaattttgtattggttcgactttacatcacccaaatgttatcgaaactgttgacgttttctctgattctaaacaaaataaatactatgaagttatggagtactgtccgattgatttttttgctgttgttatgacaggcaagatgtctcgtggcgagatcaactgttgcttgaagcaattgactgaaggtgttaaatatttacattctatgggattggcacatagagatttgaaattggataattgtgtcatgacttcccagggtattttgaaattaattgattttggtagtgctgttgtgttcagatatccttttgaagatggcgtaacgatggctcatggaatcgtgggtagtgacccttacttagcgccggaagtgattacctccaccaaatcttatgatcctcagtgcgtcgatatatggtctattgggatcatatattgttgtatggtgcttaaaaggtttccatggaaagcccctagagattctgacgataattttagattatattgtatgccggatgatatagaacacgactatgttgaatctgccaggcatcacgaagagttactgaaggaaagaaaagaaaagcgtcaaaggtttttgaatcacagtgactgttccgccatcaatcagcaacaaccagctcatgaatcaaacttgaaaacagttcaaaatcaagttccaaatactccagcatctatacagggtaaaagcgataacaaaccagacattgtggaagaagaaaccgaagaaaataaagaagatgatagcaataatgataaagaaagcacgccagataatgacaaggaaagtaccatcgatattaaaataagcaaaaatgagaataaaagcacggtagtttcagctaacccaaagaaagtagatgccgatgccgacgctgattgcgatgctaatggtgactctaacggcagagtggattgcaaggctaacagtgactgcaatgacaaaacggattgtaatgctaacaatgactgcagcaatgaatcggattgtaacgctaaagttgatactaacgtcaacactgctgccaacgctaaccctgatatggttccccaaaacaatccacaacaacaacaacaacaacaacaacaacaacaacaacaacaacaacaacaacaacaacaacaccatcatcaccagcatcaaaatcaagacaaggcccatagtatcgcttccgataataaatcgagtcaacagcacagaggacctcaccataaaaaaattattcatggcccataccgtctattacgtctactaccacatgcttcaagacctatcatgtcccgtatactgcaagtagatccaaagaaaagagcaaccttagatgatatttttaatgatgaatggtttgccgccattgctgcctgtaccatggattcaaaaaataaagttattagagcgcctggccatcaccatacattggttagggaggaaaatgctcacttagagacctacaaggtttaa

SEQ ID NO: 364 - protein, 759 aa, Saccharomyces cerevisiae
MPNLLSRNPFHGHHNDHHHDRENSSNNPPQLIRSSKSFLNFIGRKQSNDSLRSEKSTDSMKSTTTTTNYTTTNLNNNTHSHSNATSISTNNYNNNYETNHHHNISHGLHDYTSPASPKQTHSMAELKRFFRPSVNKKLSMSQLRSKKHSTHSPPPSKSTSTVNLNNHYRAQHPHGFTDHYAHTQSAIPPSTDSILSLSNNINIYHDDCILAQKYGKLGKLLGSGAGGSVKVLVRPTDGATFAVKEFRPRKPNESVKEYAKKCTAEFCIGSTLHHPNVIETVDVFSDSKQNKYYEVMEYCPIDFFAVVMTGKMSRGEINCCLKQLTEGVKYLHSMGLAHRDLKLDNCVMTSQGILKLIDFGSAVVFRYPFEDGVTMAHGIVGSDPYLAPEVITSTKSYDPQCVDIWSIGIIYCCMVLKRFPWKAPRDSDDNFRLYCMPDDIEHDYVESARHHEELLKERKEKRQRFLNHSDCSAINQQQPAHESNLKTVQNQVPNTPASIQGKSDNKPDIVEEETEENKEDDSNNDKESTPDNDKESTIDIKISKNENKSTVVSANPKKVDADADADCDANGDSNGRVDCKANSDCNDKTDCNANNDCSNESDCNAKVDTNVNTAANANPDMVPQNNPQQQQQQQQQQQQQQQQQQQQHHHHQHQNQDKAHSIASDNKSSQQHRGPHHKKIIHGPYRLLRLLPHASRPIMSRILQVDPKKRATLDDIFNDEWFAAIAACTMDSKNKVIRAPGHHHTLVREENAHLETYKV

SEQ ID NO: 365 - DNA, 920 bp, Saccharomyces cerevisiae
actagcaagatgatcgtcagatatggtgatttatttccctgtgcattgtacttcaaagatcatacagcatactaagcgctttccagggacaccttctgtcgcaaaatatcagaatttttcttgattaaacgcagcatattgagtatatgaaattaacgggacactgtgtgaaaaatttgtagttgtacttttttgttatcccctttggtagacatatggacgaattactactaagattggcttccataaggcccaaatccagatatcacctacggtatgtccttttcctacttgcaatgacaaataatttgttatttatcttggaacctatataagttacatctgattgcttttgtattttttttggagaatattattacccgcggggaaggaagtaaggggagaatttttgaggtgtataaaagagagtggaggcttaatcaatcaaagaattctttctcgtttattttcagggtttgtgactaagaaacgatattaaaatgtggaaggccgtgatgaatgcttggaatggaaccgagagtcaaagtaagaatgtttcaaatattcaatcttacagttttgaagacatgaaaagaatcgttggaaagcatgatcctaatgtggttttggtagatgttagagaaccatctgagtactcgattgttcatattcctgcttccatcaatgtgccatatagatcgcaccctgacgcatttgccttagatcctttagaatttgagaaacagattggcatcccaaaacctgacagtgccaaggagctaatattttattgtgcttctggcaaacgcgggggagaagctcaaaaagtcgcctcctcacatggatattcaaacacctcactatatcctggctctatgaatgattgggtttctcatgggggtgataaacttgacttatag

SEQ ID NO: 366 - protein, 139 aa, Saccharomyces cerevisiae
MWKAVMNAWNGTESQSKNVSNIQSYSFEDMKRIVGKHDPNVVLVDVREPSEYSIVHIPASINVPYRSHPDAFALDPLEFEKQIGIPKPDSAKELIFYCASGKRGGEAQKVASSHGYSNTSLYPGSMNDWVSHGGDKLDL

SEQ ID NO: 367 - DNA, 950 bp, Saccharomyces cerevisiae
catctgagtactcgattgttcatattcctgcttccatcaatgtgccatatagatcgcaccctgacgcatttgccttagatcctttagaatttgagaaacagattggcatcccaaaacctgacagtgccaaggagctaatattttattgtgcttctggcaaacgcgggggagaagctcaaaaagtcgcctcctcacatggatattcaaacacctcactatatcctggctctatgaatgattgggtttctcatgggggtgataaacttgacttatagccttgtatactctaggtatgtaccctgtgtattttcgtaagctagtaacgtattatgccatttatgtcacaccgttcataatatttgcctattgcattggctgtgatagcggcggcgcaaagaaattaggaagtataaaaaaaaaaatacaaaacttaatctgaatggaataagatagcgataactctcaacaaatggaagcgagacagaagaaaaagaccaacgatgttcaagcatagtacaggtattctctcgaggacagtttctgcaagatcgcctacattggtcctgagaacatttacaacgaaggctccaaagatctatacttttgaccaggtcaggaacctagtcgaacaccccaatgataaaaaactattggtagatgtaagggaacccaaggaagtaaaggattacaagatgccaactacaataaatattccggtgaatagtgcccctggcgctcttggattgcccgaaaaggagtttcacaaagttttccaatttgctaaaccacctcacgataaagaattgatttttctttgtgcgaaaggagtaagagccaaaactgccgaagagttggctcgatcttatgggtacgaaaacactggtatctatcctggttctattactgagtggttagctaaaggtggtgctgacgttaagcccaaaaaataa

SEQ ID NO: 368 - protein, 149 aa, Saccharomyces cerevisiae
MFKHSTGILSRTVSARSPTLVLRTFTTKAPKIYTFDQVRNLVEHPNDKKLLVDVREPKEVKDYKMPTTINIPVNSAPGALGLPEKEFHKVFQFAKPPHDKELIFLCAKGVRAKTAEELARSYGYENTGIYPGSITEWLAKGGADVKPKK

SEQ ID NO: 369 - DNA, 848 bp, Saccharomyces cerevisiae
gtgtattattaatacgaacaaaataaaaatatgccgaccaattctgtagtagtactgtactatattgaatattaagggtttttctggtcttagcgtatccctttatcagtccgtggaacaaagccacgggcggctgtaacaatgaccatggaatcattcagtcgccctaaaagcgcattccacggagcgtttatagtgatcttggtcacatgatatacgcgtgactttttttttattttttctccctgtcttccgcaaaagtggctcaaaattcttcggattttggcattatagcgcgaatggtgcagcgcaaccaaacaaacaccagttgtcgcacccaaaagatgcaaaagcggggagccagttagttttccttcaagttttggttgaaacagcctttaatattttatagaaaggtaaactatctgctcagtgaatagtatctgtaagtcaggcatacattcgaaacacttccaaatacaaaataagaacgcgcaacgatgtcgtcatcagtgccatacgatccatatgtgcctccagaggagagtaactcaggcgcaaacccaaattcccaaaacaagactgctgctttgagacaagagattgatgacacggtgggaataatgagagataatatcaacaaggttgctgaacgtggtgaaaggctaacatccattgaggacaaagctgataacttggctatctccgcacaaggattcaagagaggcgccaacagggtcagaaagcaaatgtggtggaaagatctaaaaatgagaatgtgtttattcttagttgttattattttactagtggtaattatcgttcctatcgtcgtccatttcagctaa

SEQ ID NO: 370 - protein, 115 aa, Saccharomyces cerevisiae
MSSSVPYDPYVPPEESNSGANPNSQNKTAALRQEIDDTVGIMRDNINKVAERGERLTSIEDKADNLAISAQGFKRGANRVRKQMWWKDLKMRMCLFLVVIILLVVIIVPIVVHFS

SEQ ID NO: 371 - DNA, 2165 bp, Saccharomyces cerevisiae
aaaatcgtggttactttcatattccttaaacactttaccactgttactgtgcgcgttcgagcgtagctttcgtggtgaatttattgtaagattctccagctggctcgatagttctgcctcctgcgtatccatatccatttcggtatgcttttactattcaacctagtcggcaattttttcacctgaatattgttgaacacttctggcatcctagatactcatctgtatttattcattatctgttgtgcatcgttaatagcattccagtaaacaagtttaggtcactacccgcataagccttttggcgtttggcgtaaccctcctcgcgaaaagaaacgggacgcaaaaaaaaaaaacaacaaaacaagaacaaaacaaaacaaataggacagagccttaaggagctgcaaggatcttctgaatatttggcatcggcattgtgggtggaaaaagtgtccaaattggaataaattggtcagaatagagcattgattccaactatggacagagatataagctaccagcaaaattatacctcaactggggcaactgcaacttcctcaagacagccctctacggacaataatgcagatacaaattttttgaaggtaatgtcagaattcaaatataattttaacagtccgttacctacaacgactcaattccccacgccctattcttctaatcagtatcaacagactcaagatcattttgccaatacagacgctcacaacagttcgagcaacgaatcgtcgttggtagagaacagtatattaccgcatcatcagcagatacaacagcaacaacaacaacaacaacaacaacaacaacaacagcaagctctaggttcacttgtacctcctgctgtcacaaggacagatacaagtgagactttggacgatatcaacgttcaaccttcttctgttttgcagttcggcaactctttacccagcgaatttttggttgcatccccagagcaattcaaagaatttttgttggactctccgtccaccaatttcaatttctttcacaaaactccggcaaagacaccacttcgatttgtaacagattctaacggtgctcagcaaagcaccacagagaacccaggtcaacaacagaatgtttttagcaatgtcgatttgaacaatcttttgaagagtaatggaaaaacaccctcatcttcatgcaccggcgcattttcacgcactcctctgagtaagattgacatgaatctcatgttcaatcaaccgctgccgacatctccatcaaaaaggttctcctccctgtcgttgacaccatatggaagaaaaattctgaatgacgtcggtacaccttatgcaaaagcattgatatcgtctaacagcgcgttagtggattttcagaaggcaagaaaggatattaccactaatgcaacatccatagggctggaaaatgccaacaacatcttacagagaacgccgctaagatctaacaataaaaaattatttattaaaaccccccaggataccatcaatagcactagcacactaactaaggacaacgaaaataaacaggacatatacggctcttcaccgactaccatccaattaaattcatcaataactaaatctatctccaaattggataactctagaattcccttgttagcttcgagatcagataacattctggattccaatgtggatgaccaattgtttgatttggggttgacaagattacctttatcaccaacaccaaattgtaattctttgcatagtacaaccacaggtacatctgccttacaaattcctgagctacccaagatggggtcttttagaagtgatacgggaatcaatccaatttcaagttcaaacacagtttcttttaagagcaaatcaggcaataataattcaaagggtcgaatcaaaaaaaatgggaagaaaccttccaaatttcaaattattgtggcaaatattgatcaatttaaccaggatacatcatcgtcatctttatcatcatcattgaatgcaagttcgagtgcagggaattcaaattcaaacgtaacaaagaaaagagcaagtaaactcaaaagatcacagtctttactttctgattccggatcgaaatcacaagcaaggaaaagctgtaattctaaatctaatggaaatttattcaattcacagtaa

SEQ ID NO: 372 - protein, 554 aa, Saccharomyces cerevisiae
MDRDISYQQNYTSTGATATSSRQPSTDNNADTNFLKVMSEFKYNFNSPLPTTTQFPTPYSSNQYQQTQDHFANTDAHNSSSNESSLVENSILPHHQQIQQQQQQQQQQQQQQQALGSLVPPAVTRTDTSETLDDINVQPSSVLQFGNSLPSEFLVASPEQFKEFLLDSPSTNFNFFHKTPAKTPLRFVTDSNGAQQSTTENPGQQQNVFSNVDLNNLLKSNGKTPSSSCTGAFSRTPLSKIDMNLMFNQPLPTSPSKRFSSLSLTPYGRKILNDVGTPYAKALISSNSALVDFQKARKDITTNATSIGLENANNILQRTPLRSNNKKLFIKTPQDTINSTSTLTKDNENKQDIYGSSPTTIQLNSSITKSISKLDNSRIPLLASRSDNILDSNVDDQLFDLGLTRLPLSPTPNCNSLHSTTTGTSALQIPELPKMGSFRSDTGINPISSSNTVSFKSKSGNNNSKGRIKKNGKKPSKFQIIVANIDQFNQDTSSSSLSSSLNASSSAGNSNSNVTKKRASKLKRSQSLLSDSGSKSQARKSCNSKSNGNLFNSQ

SEQ ID NO: 373 - DNA, 2060 bp, Saccharomyces cerevisiae
cgaccctctggttagatgacactcctgccccaactgccacgaatctgtaaccccataactatacccgtacgcagtactaaaaatgtatgtaattagtaaatgtatgtaacaatttcaccgttttgtgtaacaattcattcattcattcttttgatcctttagtaccgtccgcacatgatgtcatttccccctcatttttgtttgctggtatgattccccgcccgggcgacggtacggctgttatccagcgatgcgggacttccgtccacaggtatctttttctccaactccaacagagatggaaaatgaggggcgggtgtaggtaagcagaatgaggagaaatttgtaatgaaaatggaagttcggcggttatataaatggggggggtttgtcggtgacaattgacttcactctcctttcctcaaaaattcttgggtgttaggattagaagtatctggaaaaccaaccaagaaaactacaataacaaaaataaataaagcatgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 374 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 375 - DNA, 962 bp, Saccharomyces cerevisiae
agtaagctcctacagtgaaatatctgggtgctactgacgccaagccctacagcgatcggaatgcgggaacggaagttaacggggcttccagaacggcggaagcgaattgaacgaggacggcaaacaaaaacacccaaaatttcattacttagaatgaccctcaagagcagggtgcaatttatcaagcgatcattgaactaactaagttcatatcctgtataggatttaaaacaatgcaccctaagttcaaatgcaccccccctcgccccgcagcggacccttgaacagagaactgtttcgaggttcacccaattggatcacttgtataatttgtaatcgagttcggataagatgtatacgaatctaactgggtgcagtataattagcattttatattacctagcaatatatgtataaaacaggaatgtgtgcgtgcttcaggcagaattttacggtccttgtaaaaaagtctatcataaagccatcacaaaacaataataatgaaattctcaactattttcggagctactacagttatgactgccgtctcggcagcagctgtgtcgagtgtaatgaccactaagactattactgctactaacggtaataacgtttacactaaggtcgttaccgacaccgctgaccctatcattagttacagtaccactagaactgtcgttgtcagtaatagtgatgctacttacacaaaggttgtcaccgaaggaccagataccacctctgaaaagagtacaacaaagacacttactttgacaaacggttcaggttcatcaaccaacctttacaccaagaccgtcactcaagccgtcgaatcatctacatcctcctcatcctcctcatcctcctcctcctcttctgcctcttcttctggtgctgctcctgctgcattccaaggagcaagtgtcggtgcattggcccttggtttgatttcttacctattataa

SEQ ID NO: 376 - protein, 153 aa, Saccharomyces cerevisiae
MKFSTIFGATTVMTAVSAAAVSSVMTTKTITATNGNNVYTKVVTDTADPIISYSTTRTVVVSNSDATYTKVVTEGPDTTSEKSTTKTLTLTNGSGSSTNLYTKTVTQAVESSTSSSSSSSSSSSSASSSGAAPAAFQGASVGALALGLISYLL

SEQ ID NO: 377 - DNA, 974 bp, Saccharomyces cerevisiae
tcacggctgctcttcctctttttcgcatattctattttatcatcgacttccctaattcgcactcgtaccaaaatgttaagcagtatggcgaagaacgtggcgcgctggagtcgtgaatgtttgggtccttgatgatggactacggtagtaagtatgtagtagttgcaacttcatatgttcacttctgatccaaggaagagcggttatgaattaatctcttggcatgagcggacgggtaaggggacaccgccttttcttcgatgggaatcagggtaatggtatatgatggattattgtggaatcatttagtacggcagatgttgaaaaaaaaagcagaaaatttttgaatttttttcgttgacattggaagatttcgtagtggaaacagctgcaattgcttgttaagtagtaacccctcctttgtcacaagagagcgaatattctttctagggaggtttaagaatagaacatctcacaccagacgcgactcataattcataatgccaattgaccaagaaaaattagctaagctacaaaagttgtctgctaacaacaaagttggtggtactagaagaaagcttaacaagaaggcaggctcttctgccggtgccaacaaggatgacaccaagttgcaaagtcaattagctaagttgcacgctgtcaccattgacaacgtcgccgaagccaactttttcaaggacgacggtaaggtcatgcacttcaacaaggtcggtgtccaagttgctgctcaacacaacacttctgtattctacggtctaccacaggaaaagaacttgcaagatttgttcccaggtattatctctcaattgggccctgaagccatccaagccttgtctcaattggctgcccaaatggaaaagcacgaagccaaggctccagctgatgctgaaaagaaggatgaagctattccagagttagttgaaggtcaaacttttgatgctgacgtcgaataa

SEQ ID NO: 378 - protein, 157 aa, Saccharomyces cerevisiae
MPIDQEKLAKLQKLSANNKVGGTRRKLNKKAGSSAGANKDDTKLQSQLAKLHAVTIDNVAEANFFKDDGKVMHFNKVGVQVAAQHNTSVFYGLPQEKNLQDLFPGIISQLGPEAIQALSQLAAQMEKHEAKAPADAEKKDEAIPELVEGQTFDADVE

SEQ ID NO: 379 - DNA, 1235 bp, Saccharomyces cerevisiae
taaactgtgttgtgacgcaactgcaactcccagatgaaatacggtccggtaaagataggaatattctactctacaagcatgaatattttttaacgcggcgcagtactatacagcataacaggtcttccacgcatgagaaactgtccatggctaaattagttcctcacacagaattagaaatgtgctgtgacaatggcacatacgtagataaaagataaatataattcagaatggctgtggcgacaactattatcatagaggtgtcccatcgagcgagcctcattggccgggtaatcgacatcaatattgaaccaatcacgacgctttttctcttcaccgctcattcggaccttcaccacaggtttgggtaattaaaatagcaagggattataattgcagttagcagtttatgttgacaagtttatactgtgctaggaagggttatattttattaaaagactgacgagaattcagtacctcctaagtgcgcaagagataaaatgagcatgagtatgggtgtccgtggcctagcgttaaggtccgtttctaaaacattatttagccaaggtgttcgttgtccttcgatggtgattggagcccgttatatgtcttccactccagaaaaacagacagatccaaaagcaaaggctaactctatcatcaatgccattccaggtaataatattttgacaaagacgggggttttggggacttctgctgccgctgtcatttatgccatttccaatgaattgtacgttatcaacgatgaaagtattttattgctgacttttttgggtttcactggtttagtggcaaagtatttggcgccagcatataaagattttgccgatgcaagaatgaagaaagtctccgacgttttaaatgcctcgagaaacaagcatgtcgaagctgttaaagatagaatcgactctgtctctcaactacaaaatgttgctgaaactacaaaggttttgtttgatgtttccaaggaaactgttgaacttgaaagcgaagcctttgaattgaaacaaaaggtagaattagctcacgaagcaaaggcagtcttagattcgtgggttagatatgaagcttccttgcgtcaattggaacaaaggcaactagcaaaatctgtcatctccagagttcagtcagaattgggtaatccaaaattccaagagaaagttttgcaacagtctatatctgaaattgaacaattgctttctaaattgaagtaa

SEQ ID NO: 380 - protein, 244 aa, Saccharomyces cerevisiae
MSMSMGVRGLALRSVSKTLFSQGVRCPSMVIGARYMSSTPEKQTDPKAKANSIINAIPGNNILTKTGVLGTSAAAVIYAISNELYVINDESILLLTFLGFTGLVAKYLAPAYKDFADARMKKVSDVLNASRNKHVEAVKDRIDSVSQLQNVAETTKVLFDVSKETVELESEAFELKQKVELAHEAKAVLDSWVRYEASLRQLEQRQLAKSVISRVQSELGNPKFQEKVLQQSISEIEQLLSKLK

SEQ ID NO: 381 - DNA, 1404 bp, Saccharomyces cerevisiae
aaataggacgaagaactttttatatacgagcatttcctaattagtaggaagcggaaaataataatataagaaagtaaacgcaaaagataggctgactgccttcattcgactaggaggtgaggcgacatatttgtcaccattcaagttaccgagatggtagagaggtggatggctcgggtgagcttgattgtacactgcagcaacgatgctttttctacccattttatgaagtttaacatccgtacctttccacctccaaacattttttgtaacttcgtcctttgaaaaatcaagaagtaataggtgtgcagtatagggccgcttgagcgcgcaatatcggtgagtgaggtaagatccatccataccttagcaaatatggtagtgaggaggccaactgtattgcgttaaaggcaaaaggattggtatatacgaatgattggtaatttgaaaagtaggtttcgaatcaaagaaactgagacagtcaaggacactaaacaaaaatgggtaaatcgtatgtccatataacttcaaaatgaaaatatagcagttgaaacatatcaattaaatcattatacatctccaataaacatgtatgcaagaggaaagcgtaaatatcttcgatttcgacaatactttgctactgaactaaaaatgaaaatgaagttgaattctcaaaggaatgtgatgcaagttcgttaattaatatggtttttagtggaattatcatagtttgtgatagatacacacgaggagtagtgagcaaagcaagtgcaacagcaatgatatgttagcaggaaataatattataaattggatattgtgtgtttttttgatatatgtttgtcgaagctaatacagaatgattactaactggaatttaaaagcacaatcatgctcttggatgattgatctattaaaaaattataaaacagacatggttacagatctcgtacacgttacatgttccaacgtgacttcagaaagcatggtgccgttcacatgtccacctacttgaagatctacaaggttggtgacattgtcgacatcaaagccaatggttctatccaaaagggtatgccacacaagttctaccaaggtaagaccggtgtcgtctacaacgttaccaagtcttctgttggtgttatcatcaacaagatggtcggtaacagatacttggaaaagagattgaacttgagagttgaacacatcaagcactctaaatgtagacaagaatttttggaaagagttaaggccaatgctgctaagcgtgctgaagccaaggcccaaggtgttgctgtccaattgaagagacaaccagctcaaccaagagaatcccgtattgtctctactgaaggtaacgttcctcaaactttagctccagttccatacgaaaccttcatttaa

SEQ ID NO: 382 - protein, 161 aa, Saccharomyces cerevisiae
MGKSHGYRSRTRYMFQRDFRKHGAVHMSTYLKIYKVGDIVDIKANGSIQKGMPHKFYQGKTGVVYNVTKSSVGVIINKMVGNRYLEKRLNLRVEHIKHSKCRQEFLERVKANAAKRAEAKFAQGVAVQLKRQPAQPRESRIVSTEGNVPQTLAPVPYETFI

SEQ ID NO: 383 - DNA, 7088 bp, Saccharomyces cerevisiae
tttttcatgaggaagagccagtgacagtaaataataaaaggtgaaatgattaaacaatgaaagcggcagaaaaataaaatcaaacagtggcagtattgacttttgaaaatcagaagttcatcctaagttaagactttcttcttttaagtgctttctccttctctcactgtcttatcgctgtatatctcattgttgaataatataacacaacgttataagtgatcatcactttctgatccataatttcaaacctcaagcgaccgtacatgtggcattttccactataaacttacgagcaagagaaagatatacggaaaaggttaattggcaggttacacaagattttggtcattgaatatttgcagccctcctgcttgagaaactggacaacaactgttatcaatattcccttttcaaaatagtggtatttaactggccataaccaaggaaaccgttgtacctattattttgtatagtcttcatttaataacgtgttaagaatgacacctgaagccaagaaaaggaaaaaccaaaagaagaagttgaagcaaaagcaaaaaaaagctgctgagaaagctgctagccacagtgaagaaccacttgaattaccagaaagtacgattaacagcagcttcaacgacgactcggtgaaccgtacagaatctgacatagcttcaaaatctgatgttcctccggtctcatcatctaccaatatctctccggctaatgaaacacaactagaaatacctgatactcaagaattgcatcataaactgctcaacgactctgatcaacatgatattaccgcggactcaaatgatttgccagacaactcaatcgttgaacatgactctgttattacccaaacaaaaccagccatgtctcaagaatacgaagagactgccgctcacttatcttcgagaaatccatcgctcgatgtagtcgcgggagaacttcacaataataatgaacatacccagaaaattgccgtatccgctgtggaagaggattctttcaatgaagaagagggtgaaaatcacgacagcataataatttcatcattaaacgatgctaccccttctcaatataatcattttctcccatccgatggcaatcttctttctccagaattatcttctggtgatacgccaactcacaatgttcctctaggcacaaaagacaatgaaataaatgacgatgagtattgtaatgataaggaaattagtttgaacgcaaataatgtgcttcctgatgaactttcaaaggaagaagatgaaagattaaaactagaaacgcatgtatcaaccgaagaaaagaaacaggatatcgctgatcaggaaactgcagaaaacttatttacgtctagtacagaaccatctgagaataaaataagaaattctggtgatgatacctccatgttgtttcaagatgacgaaagtgatcagaaggttccatgggaggaagatgtgaagaaagattttcataatgagaacacaaataatactcaagaatcggcaccgaacacagatgatcgtgataagggttatgaaggaaacgaagctttgaaaaagtccgaaagttgtacagccgcggacgagaggtcgtactctgaagaaacttcagaagatatctttcacggacacgacaaacaggtagttgaaggccaaaatgatttcactgggaaaaatattgagaatgaaagccagaaattaatgggggaagggaatcataagttaccgttgtctgccgaagctgacattatagaacctggtaaggatattcaagatcaagccgaggatttgtttacgcagagcagcggagacttgggagaagttttgccatgggaatctactgataaaaacgctgatgtaacgagcaaatcccaagagaaacatgaagatttatttgctgcttctggaaacgatgagaaacttccttgggaagtttctgacggtgaagtatcatcgggaaagacggaaaacagcatgcagactagtactgagaaaatagctgagcaaaagttttcgtttttggaaaacgacgacgaccttttggacgacgacgacagctttttggcttcttctgaggaagaagacacagtacctaataccgataatacaacgaatttaacctcaaaaccagttgaagaaaaaaaggcttcaagatataaacctattatcgaggaggaagcaggaatgcgtcaagagcaagttcattttaccaatactactggcattgtaacaccgcagcagttccacggtttgactaaaactggactaggcacccccaaccaacaagtcagtgtaccaaatatagttagtcctaagcctcctgtggtaaaagacaatcgttcaaattttaagataaatgaggagaaaaagaagtctgatgcttacgattttccactggaaattatttcagaaagttccaagaagggtcacgcaaagccggttgccgttcctactcaaaggtttggctcagggaattcttttagttctttggacaaaccaattccacagagcaggaaaggctctaataactcaaataggccacccgtgatcccattggggacgcaggagcctcgatcttcgagaactaactcagcgatctcgcaatctcccgttaattatgctttccctaacccatacaaaattcaacaactacaacaggctcctatccaatcaggtatgcctttaccaaataccaacatacctcccccagcattaaaagtggaaaccaccgtttctgctcctccaattcgggcaagaggggtcagcaatgcctccgtgggaagttcagcgtcttttggtgctagacatgcaacacagtacggcctcaataacggggtacctccggtttcgccatatggtcaagctaccataaatttgccaactgcgaataagtatgcccccgtctctcctacagttcagcagaagcaatatccatcagttgtgcaaaaccttggcgcttcggccgtaaatacccccaattttgtaaagacccatagaggccatacaagctctattagttcgtatacaccaaaccagaatgaacacgcctctagatacgcacccaactatcaacaatcttatcaggtgccatatacctcacaacctgttggtcctgtagctgggaattcaagctatcaaagccaaacccgaagttcttatgcagttcctatgatgccccaggctcaaacttcagcaagtattcagcctcacgcgaacattcaaccgcctactggcattttacctttagcccccttacgacctctagaccccttacaagccgctacgaacttgcaaccccgtgcaagcaacataacggctgcaaattcactacctcttgcaaatttgccacttgctgaaaacatactgccagaaattatcacgcatcgagctacaagtagtgttgcaccaccacgacaggaaaataatccaattaaaatagacaacgaggctttattacgccgtcaatttccgatttttcattggagtgctgcaaacaaggtcgtgtacgcagtcccccctatccctgaccaatcgcagtacatgatttcatcaagcattgtacaggaaataaaagtgacaccaattgaccagataattaaaccgaacgatatgctcaaaagcttcccaggtcctttgggtagtgccaaattaaaaaaaaaggatttaaccaaatggatggaaaccactattaaatccatatctgaaaatgaatcatccactgatatgactatatggcaactattggaaatgaaactaaacgataaagttaactggaaaaatatttcaaaactactatacaattctgacgaacttttaatgtacctatctcagccctttccaaacggtgacatgattccaaatgcatatagactggatataaattgtcagatgagagtcctggcgttcttacaaacgggaaatcacgatgaggcacttcgcttagctttaagcaagagggattatgccattgcactattggttggcagtttaatgggtaaagacagatggtctgaagtcattcagaaatatttatatgaagggtttactgcggggccaaacgaccaaaaagaattggcacactttctgctccttatctttcaagtatttgttggtaactccaaaatggccataaaaagtttctacactaataatgagaccagtcaatgggcatccgaaaactggaagagtatcgttgcagctgttctgattaatatcccagaaaataatgaagatccactacttataccacctgttgtccttgaatttttgatagagttcggtatattcctcaccaaaaagggcttgacagccgcagctagtacattatttattattggtaacgtaccactttctaatgagccagtaatggcagattcagacgttatatttgaaagtattggaaacatgaatacttttgaaagcattctatgggatgaaatctacgagtatatattctcgtatgaccctaaattcaaaggattttcatctattttgccccagaagatataccatgcatctcttttacaagaacaaggtttgaacagcctggggacaaagtatactgattacctcagttcctcagttcgaaaactgcctaagaaagatattttaacaataaacctcactcgtgaattgagtgaggtggctagtaggctttccgagtctaatacaggatggcttgcaaaaccaaaactaagcagcgtatggggtcaattagataaatccttcaataaatatattggtggcgatgatattgatgcattgaataaaaaaaatgataaaaagaaagtttttgatgggttcacaccgggatcttctgccaattcgtcaactgtggatctcacccaaacattcacacctttccaagctcaagttacttcgcaaagctatgtggatactacagctcttttgcataatgcccataatgtaccaagccatagtgtgctgcattcaaagccttccaatgtgtcaaaggggttagttgaagcaaacttaccgtatacgcataggatcggtgatagtttgcagggatctcctcagcgcattcataatacacagttcgctgctgctgagcctcaaatggcttctttgagaagagttagaacagaccagcatacaaacgaaaaggctttgaagagtcagcagattttagagaaaaagtctacggcctacactccacaatttggacagaaccatagcgttccaatggaaaagtctaattcgaatgtgccatctttatttgccgacttccctgctccacccaaacttggaacagtgccgtctaattatgtgtctagtcctgacttagtaagaagggagtctatcatatctaccggatcagaatttcttcctcctcccaaaattggggtacctactaaagctaattcctcgcagggatcgcttatgtactcaccaagtgtggaagctttgcctatcgaccctgtcgtcccgcaagttcatgagacgggatacaatgattttggtaacaaacattctcaaaaaagtatgcctgaagatgaatctcacacatcacatgataatagcaatgctgatcaaaatacattaaaagactctgcagatgttacagatgaaacaatggatattgaaggacctggcttcaacgatgtgaagaatcttcttcctatggagcccaaccaccagcctacgtctacagtaaatcctatacaaactattagtgacgatatccaaccgattcttcaaactaacgtggaggtccggggtactgatgcatcgaaaatggaaaattcacttccctccattgaaaatgaaagaagtagcgaggagcagccagaaaacatttcaaaatcagcatcatcagcatatttaccatcaactggtggattgtcactcgaaaacagaccgctaactcaggatgaaaacagtatctcagagacagttcaatccacatacttgccagcaggaagtatttcaatggaagctaaaccaatttctcaagtgcaagatgttccaagaaatgttaataataaagcatccaaacttgtggagcaacatatggcaccaccaaagccaaaaagtactgacgcaaccaaaatgaactactcaccatacgtgcctcaatcaactgccgctagtgcagatggcgatgaatcaacgattctgaaaacatcgcctgctatatatgcaagaactcaccaagcacatgcatccaatccatcacaatactttcctttggtcaaccaagcaaatgaaactgcttcattcgaattatctgaatcaacatcccaggcacaaagtaatggaaatgttgcttcagaaaatagattcagcccaataaagaaagccgaagtcgtcgagaaagacacttttcaacctactattaggaaggcttcaactaaccaatacagggcttttaaaccgttggaatcagatgcggataaatacaatgacgttattgaagatgaatccgatgacgacaatatgtctactgatgaggcaaagaacagaaaggaagaaaaaaagaatgtgaatatgaaaaaggaaacaaaaccaagtaacaaggacatagatgacaagtctaatggttggtttggttggttgaagaaagatactggcgacaaaaaagtgtataaggccaagctaggtcataaaaacacactatactatgatgaaaaattgaaacgttgggtgaataaggacgcaaccgaagaggaaaaacaaaaaattattgaaagttcggcaccaccacctcctccaatcgtgaaacgtaaagatggcggcccaaagacaaagccacgttcaggccccatcaataattccctacctccagtacatgccacatcagttattccgaacaatccaatcactggtgagcctttgccgatcaaaacatccccttctcctacaggacccaatccaaacaattctccatcaccatcctctcccatatcaaggatttctggcgtaaacttgactagcaaaaaggcaaacggtttggatgatttattgagtttggcaggaggacccaaaccagcaagtacgagaaggaagaagaaaacagcgagaggctatgttaatgtaatggataacatacaataa

SEQ ID NO: 384 - protein, 2195 aa, Saccharomyces cerevisiae
MTPEAKKRKNQKKKLKQKQKKAAEKAASHSEEPLELPESTINSSFNDDSVNRTESDIASKSDVPPVSSSTNISPANETQLEIPDTQELHHKLLNDSDQHDITADSNDLPDNSIVEHDSVITQTKPAMSQEYEETAAHLSSRNPSLDVVAGELHNNNEHTQKIAVSAVEEDSFNEEEGENHDSIIISSLNDATPSQYNHFLPSDGNLLSPELSSGDTPTHNVPLGTKDNEINDDEYCNDKEISLNANNVLPDELSKEEDERLKLETHVSTEEKKQDIADQETAENLFTSSTEPSENKIRNSGDDTSMLFQDDESDQKVPWEEDVKKDFHNENTNNTQESAPNTDDRDKGYEGNEALKKSESCTAADERSYSEETSEDIFHGHDKQVVEGQNDFTGKNIENESQKLMGEGNHKLPLSAEADIIEPGKDIQDQAEDLFTQSSGDLGEVLPWESTDKNADVTSKSQEKHEDLFAASGNDEKLPWEVSDGEVSSGKTENSMQTSTEKIAEQKFSFLENDDDLLDDDDSFLASSEEEDTVPNTDNTTNLTSKPVEEKKASRYKPIIEEEAGMRQEQVHFTNTTGIVTPQQFHGLTKTGLGTPNQQVSVPNIVSPKPPVVKDNRSNFKINEEKKKSDAYDFPLEIISESSKKGHAKPVAVPTQRFGSGNSFSSLDKPIPQSRKGSNNSNRPPVIPLGTQEPRSSRTNSAISQSPVNYAFPNPYKIQQLQQAPIQSGMPLPNTNIPPPALKVETTVSAPPIRARGVSNASVGSSASFGARHATQYGLNNGVPPVSPYGQATINLPTANKYAPVSPTVQQKQYPSVVQNLGASAVNTPNFVKTHRGHTSSISSYTPNQNEHASRYAPNYQQSYQVPYTSQPVGPVAGNSSYQSQTRSSYAVPMMPQAQTSASIQPHANIQPPTGILPLAPLRPLDPLQAATNLQPRASNITAANSLPLANLPLAENILPEIITHRATSSVAPPRQENNPIKIDNEALLRRQFPIFHWSAANKVVYAVPPIPDQSQYMISSSIVQEIKVTPIDQIIKPNDMLKSFPGPLGSAKLKKKDLTKWMETTIKSISENESSTDMTIWQLLEMKLNDKVNWKNISKLLYNSDELLMYLSQPFPNGDMIPNAYRLDINCQMRVLAFLQTGNHDEALRLALSKRDYAIALLVGSLMGKDRWSEVIQKYLYEGFTAGPNDQKELAHFLLLIFQVFVGNSKMAIKSFYTNNETSQWASENWKSIVAAVLINIPENNEDPLLIPPVVLEFLIEFGIFLTKKGLTAAASTLFIIGNVPLSNEPVMADSDVIFESIGNMNTFESILWDEIYEYIFSYDPKFKGFSSILPQKIYHASLLQEQGLNSLGTKYTDYLSSSVRKLPKKDILTINLTRELSEVASRLSESNTGWLAKPKLSSVWGQLDKSFNKYIGGDDIDALNKKNDKKKVFDGFTPGSSANSSTVDLTQTFTPFQAQVTSQSYVDTTALLHNAHNVPSHSVLHSKPSNVSKGLVEANLPYTHRIGDSLQGSPQRIHNTQFAAAEPQMASLRRVRTDQHTNEKALKSQQILEKKSTAYTPQFGQNHSVPMEKSNSNVPSLFADFPAPPKLGTVPSNYVSSPDLVRRESIISTGSEFLPPPKIGVPTKANSSQGSLMYSPSVEALPIDPVVPQVHETGYNDFGNKHSQKSMPEDESHTSHDNSNADQNTLKDSADVTDETMDIEGPGFNDVKNLLPMEPNHQPTSTVNPIQTISDDIQPILQTNVEVRGTDASKMENSLPSIENERSSEEQPENISKSASSAYLPSTGGLSLENRPLTQDENSISETVQSTYLPAGSISMEAKPISQVQDVPRNVNNKASKLVEQHMAPPKPKSTDATKMNYSPYVPQSTAASADGDESTILKTSPAIYARTHQAHASNPSQYFPLVNQANETASFELSESTSQAQSNGNVASENRFSPIKKAEVVEKDTFQPTIRKASTNQYRAFKPLESDADKYNDVIEDESDDDNMSTDEAKNRKEEKKNVNMKKETKPSNKDIDDKSNGWFGWLKKDTGDKKVYKAKLGHKNTLYYDEKLKRWVNKDATEEEKQKIIESSAPPPPPIVKRKDGGPKTKPRSGPINNSLPPVHATSVIPNNPITGEPLPIKTSPSPTGPNPNNSPSPSSPISRISGVNLTSKKANGLDDLLSLAGGPKPASTRRKKKTARGYVNVMDNIQ

SEQ ID NO: 385 - DNA, 2531 bp, Saccharomyces cerevisiae
ttccacgttcgcaaaaaatacttccacggtgacgaagtctgtctcagtcgtatattaaatgcagaaatcgtcttatcattattgggctctcttaacggcgcagcatcaccgggtgatgaatgccaagccgcagaaagaaagaaaaaaatttacttcagatttctgataaaaataaaacggaagagatgaaagctaataatagaaacagctcgatcttcctctgaacaataataattaaaggacagacaaaaagaaacgtaagaaagaagcgagcctgttctaaagtgttcaacgactgattcaattagaactgcctactcctgatagccaactcaacttttgactcgttaaagtaattgaaagctggcaagcagaattattctttttttttttcaaggtttctatcacgttgtgaggttaatatcccccggagcaaacaggctgaagcgtgaaaaaaacttaaatattaaagtgtcgcaaaactatactatagatacaacatgggtagacggaagattgaaatccagagaatttctgatgacagaaatagggctgtcacgtttataaaacgtaaagctggcctttttaagaaggcccatgaactatccgttctttgtcaagtagacatagccgtcattatactggggtccaataacacgttctatgagttttcctctgtggatacgaatgatttaatctatcactaccaaaatgacaaaaacttgcttcacgaagtgaaagatccttccgattatggagactttcacaaaagtgcatccgttaacataaatcaagacctactcaggtcgtctatgtcaaataagccttcgaaatcaaatgttaaaggaatgaaccagtcagaaaatgatgatgatgagaacaatgatgaggacgacgatgatcatggcaattttgagaggaattcaaatatgcattcgaataaaaaagcctctgataaaaatataccgagtgcacacatgaagttgttatccccgaccgcactcatttcaaagatggatggtagtgagcaaaataaacgtcatcctgagaacgcgctgccgcctttacaacatttgaaaagattgaaaccggatcctttgcaaataagtagaactccgcaacagcaacagcagcaaaatatatcgagaccataccatagtagcatgtacaatcttaaccagccttcatccagttcatcttctccttccacgatggattttccaaaattaccaagctttcaaaactcttcctttaatggtcgtcctccacccatttccatttcaccgaacaagttcagtaagccatttacaaatgcatcctcaaggacccctaaacaggagcacaaaattaacaatagtggcagcaataataatgacaacagcaactacactcagtcaccatctaattctttggaagactctattcagcagactgtcaaagcaagaaggaaattgtccgccagaccggtacttcgtgtgagaattccgaacaacaatttcagcagtaattccgctattccaagtgaaccctcctctgcctcctccacatcggccaacggcaatagtatgggctcttcgcagataatgaaagaaaacaaaacaagtaggtctagcaaaatttctccactatccgcatctgcctcaggccccttaactctccaaaaaggtaataatggcagaatggtaataaaattgccaaatgcaaatgcgcctaacggttctaacaatggtaatggcagtaacaataacaatcacccttatcctttcggaagtgggtcttcacctcttttttctgcaacacagccatacattgccactcccttgcaaccatcgaatattcctggcggacctttccaacaaaatacatcttttttagctcaaagacaaacccagcaataccaacaaatgtctttcaaaaaacagagccaaacagtaccattaactacaacattaaccggacgccccccttcaactttttccggccctgaaaccagcaatggccctccaactggttcactgccatcgaagttcgtacatgatttgatgagtaattctccaaatgtttcttctatatcgatgtttccagactggtcaatgggacccaacagtgccaagccgggaaacacaaacaatcctggtactttccctcccgtacagacggccgtaaacaacggcaactccagcaatatcagcagcactaacaacactaacaacaacaacaacaataacaacaacaacagcagcaacaacaacagcaacaacggcaacgacaataacagtaacaatagcaataacagttactatagtaataatgaagatgcacccgtaaatggagctgctatttcagaacatactaccgatggtgactcgaacaatcagtccaactcaagtacatatgatgctgctgccaccgcatataatggaaataccgggctgactccatacataaatactgctcaaacaccactaggcactaaattctttaatttttcgactgatatttcaggagaaaaaaattcaagcaaaatataa

SEQ ID NO: 386 - protein, 676 aa, Saccharomyces cerevisiae
MGRRKIEIQRISDDRNRAVTFIKRKAGLFKKAHELSVLCQVDIAVIILGSNNTFYEFSSVDTNDLIYHYQNDKNLLHEVKDPSDYGDFHKSASVNINQDLLRSSMSNKPSKSNVKGMNQSENDDDENNDEDDDDHGNFERNSNMHSNKKASDKNIPSAHMKLLSPTALISKMDGSEQNKRHPENALPPLQHLKRLKPDPLQISRTPQQQQQQNISRPYHSSMYNLNQPSSSSSSPSTMDFPKLPSFQNSSFNGRPPPISISPNKFSKPFTNASSRTPKQEHKINNSGSNNNDNSNYTQSPSNSLEDSIQQTVKARRKLSARPVLRVRIPNNNFSSNSAIPSEPSSASSTSANGNSMGSSQIMKENKTSRSSKISPLSASASGPLTLQKGNNGRMVIKLPNANAPNGSNNGNGSNNNNHPYPFGSGSSPLFSATQPYIATPLQPSNIPGGPFQQNTSFLAQRQTQQYQQMSFKKQSQTVPLTTTLTGRPPSTFSGPETSNGPPTGSLPSKFVHDLMSNSPNVSSISMFPDWSMGPNSAKPGNTNNPGTFPPVQTAVNNGNSSNISSTNNTNNNNNNNNNNSSNNNSNNGNDNNSNNSNNSYYSNNEDAPVNGAAISEHTTDGDSNNQSNSSTYDAAATAYNGNTGLTPYINTAQTPLGTKFFNFSTDISGEKNSSKI

SEQ ID NO: 387 - DNA, 2909 bp, Saccharomyces cerevisiae
taatcttcgctacttcaagtttcataatcaatcgactttctgtatgggtaagcatctggtgtgatgcagtttcattatgacaccacaaatacaaaagagactatttaaatatgtatatagatcacattccaaaaaagaaaaccattaataatatcactctttaatattccaaattgaaacgaaaaagcgctattcttattcgcttcctaactaccgccctagttcgtgcttgcatttttttgtagaacgataaattatggtatcccacgtgattgagtgtaaccctgaattgttgaagagaaaatgaagcggaagaagcaaaggacaaaaaacaattcatttgattttgccacttctaaatgaaggtctaataaaagctatcttgagcatctttattagattctgcacagcaacaagcgattttctttggtcaaaatataataattgacttacgtttttcccggactgtcctttcataatataataaccatctgcaagccatgtcagatgaaaaccataacagtgatgttcaagatattccttcacctgaactatccgtcgatagtaactctaacgagaatgaattgatgaataactcaagcgcagacgatggaatcgaatttgacgccccagaggaagaaagagaagccgaaagggaggaggaaaatgaagaacaacacgaactggaagatgtgaacgatgaagaggaggaagataaggaggaaaaaggagaggaaaacggggaagtaataaacacagaagaagaagaagaagaagaacatcaacaaaaaggcggaaatgatgatgacgatgatgataatgaagaggaagaagaggaagaagaggatgatgacgatgatgatgatgacgacgatgatgatgaagaagaagaagaagaagaagaagaagaaggcaacgacaacagttcggtaggctcagatagtgccgctgaagacggtgaggatgaggaagacaaaaaggataaaaccaaagataaagaggtcgaacttcgccgtgaaacattggaaaaagaacaaaaggacgtagatgaagctataaaaaaaataactcgtgaagaaaatgataatactcactttccaactaatatggaaaatgttaattacgatcttttacaaaagcaagtcaagtacattatggacagtaacatgctaaatttgcctcagtttcaacatttacctcaagaagaaaagatgtctgcgattttagcaatgttaaattcaaattctgacacagctctttccgtacctcctcatgatagtactatctcaacaacagctagcgcctcagccacaagcggcgcaagaagcaatgatcaaagaaaacctccattgtcagatgcccaaagacgtatgagatttcctagggcggatttatctaagccgattaccgaagaagaacacgaccgttatgcagcctatttgcacggtgaaaataaaatcaccgagatgcacaatattcctccgaagtcaagattattcattggtaatttgccgctaaagaacgtttctaaggaggatttatttaggattttctctccatacggtcatatcatgcaaatcaatatcaaaaatgcctttggattcattcagtttgacaaccctcaaagcgttagagatgcaattgaatgcgagtctcaagaaatgaactttggcaaaaagttgatcctggaagtttctagctcgaatgctcgtcctcaatttgatcatggtgatcacggtacaaacagtagttctacttttatttcttccgcaaaacgaccatttcaaactgaatctggtgacatgtacaatgacgacaatggtgctggctacaagaaatccagaagacacaccgtttcttgcaacattttcgttaaaagaaccgcagatcgtacgtatgccattgaggttttcaacaggtttagggacgggactggtttggaaactgatatgattttcttgaaaccaagaatggaactgggaaagcttatcaatgatgccgcatataatggggtgtggggcgttgttttagttaataaaacacacaatgtagatgttcaaactttctacaaaggctcacaaggtgaaacgaaatttgatgaatatattagcatatccgctgatgacgcagttgccatttttaataacatcaaaaacaacagaaataattctcgtcctactgattaccgtgctatgagccatcagcaaaacatatatggcgctcctcctcttcctgttccaaacggcccagctgtcggacctcctcctcaaacaaactattaccagggttacagtatgcctcctccacaacaacaacagcaacagccatatggtaattatgggatgccaccaccatcccatgaccaaggatatggttctcaacctccaattccaatgaatcagagctacggtcgctaccagacttctattccaccaccacctccacaacaacaaattcctcaagggtatggtcgttatcaggctggtccgcctcctcaaccaccttctcaaactccaatggaccagcaacaactattatctgccattcaaaaccttccacctaacgttgtatcgaatttgctttcaatggcccaacaacagcaacaacaacctcatgctcagcagcaattggttggtttaatacaatcaatgcaaggccaggctcctcaacaacagcaacaacagttgggtggatattcctctatgaactcatcctctccccctcctatgagtaccaattacaatggtcaaaatatatctgcaaaaccctctgccccaccaatgtcacaccaacctccgccacctcaacaacaacaacaacaacaacaacagcaacagcaacagcaacagcaacctgctggcaataatgttcaaagtctattagatagtttagcaaaactacaaaaatag

SEQ ID NO: 388 - protein, 802 aa, Saccharomyces cerevisiae
MSDENHNSDVQDIPSPELSVDSNSNENELMNNSSADDGIEFDAPEEEREAEREEENEEQHELEDVNDEEEEDKEEKGEENGEVINTEEEEEEEHQQKGGNDDDDDDNEEEEEEEEDDDDDDDDDDDDEEEEEEEEEEGNDNSSVGSDSAAEDGEDEEDKKDKTKDKEVELRRETLEKEQKDVDEAIKKITREENDNTHFPTNMENVNYDLLQKQVKYIMDSNMLNLPQFQHLPQEEKMSAILAMLNSNSDTALSVPPHDSTISTTASASATSGARSNDQRKPPLSDAQRRMRFPRADLSKPITEEEHDRYAAYLHGENKITEMHNIPPKSRLFIGNLPLKNVSKEDLFRIFSPYGHIMQINIKNAFGFIQFDNPQSVRDAIECESQEMNFGKKLILEVSSSNARPQFDHGDHGTNSSSTFISSAKRPFQTESGDMYNDDNGAGYKKSRRHTVSCNIFVKRTADRTYAIEVFNRFRDGTGLETDMIFLKPRMELGKLINDAAYNGVWGVVLVNKTHNVDVQTFYKGSQGETKFDEYISISADDAVAIFNNIKNNRNNSRPTDYRAMSHQQNIYGAPPLPVPNGPAVGPPPQTNYYQGYSMPPPQQQQQQPYGNYGMPPPSHDQGYGSQPPIPMNQSYGRYQTSIPPPPPQQQIPQGYGRYQAGPPPQPPSQTPMDQQQLLSAIQNLPPNVVSNLLSMAQQQQQQPHAQQQLVGLIQSMQGQAPQQQQQQLGGYSSMNSSSPPPMSTNYNGQNISAKPSAPPMSHQPPPPQQQQQQQQQQQQQQQQPAGNNVQSLLDSLAKLQK

SEQ ID NO: 389 - DNA, 1886 bp, Saccharomyces cerevisiae
atttcatcacttcattagttataaaaaggagttcccattgcaggagaaaataatcattgtttattgtcgctaattttctttccaataacgataactgcagtttccatttccaggtcgccaattggttggacaacgttgatgttaccttccttgttatggaaccatccatcattttctagttcttcttctgcaatattgccttttgggaagaaggatcgaaagtagccatttgcagacacgtttttactatatttactgtatcttcgattgcgcggctaaagttgccatattattattatattgcagctcaaccccgcatttccggagttttctttttttttatttggggtaatttggaggtcggcggctattggtgggccggaaatggtgacacacttgtaatatataaggaggaaatcctacatgtgtataagcgaaatcacaaggataataatgtattgctaaacaccctcaagaaagaaaataatcataacgaaatcatgggtatacctatgcaaatataccaggatgggaagggggtgcaattttaccacacgagatatcagaacgtatttgacgaacgggcgagcaagtatggcaactacacggtgaataatgattacccacagcttccagatacgataaaggaacatatcgaccagcttacctttagcaatgtcggagaggatggtggagatgttggaaactattctgaagaagacgatgatggtgacgaagaaaaggaacttgaagatgtttttcgaagtaaccgtgggttggaatttgtacggattaataactattttactacccacgatttacaaagtttcaaaagttttagaaatttcaatagcaagtactggattttttattctaatcaagcagaggacaaaaaattactgctgtatgactttaacggccaacatttgatttttattaagcagcaattttacgggcagttgaatttactgctatcggacgcaataatatgtatggactgcaattttggttataattcaaacaccattcaaattttagttggatttcagaatggaaagttgttaaagctaaactgcgacttgaacggaaacgtaaacaatcacttgcttttgaaggatccttcaacttcctctcatcaaagccacctatctatattaaatgtctgggcaggtttgttgccacatttcgttgtttcttttagtttgaaagatgggctgctaataacttctttagatcaccaacaaagcaatggaagttttcaaagtttccataccaacattgatttgcctgtagatctacgcacgaccacaaatgtcaagtccgttttaaatttccctcagtttactttatacaaaggaaatgatatgattttccactgcaagaatctattaggatcggatgcttccacgctaaacaaggaaataaactttatgcttaaaatagacgaagacgttcaaaagatcgactatcttcttaaaacgaatcacattttactcgaaaccaacatgagatatctgtccattccaacaagagaccccatagagaattcaaattcttctccacccgtctcagacagcgaggtttatccaatattttacaagacacaagaacttcatgtccatgcttcaggaacaggacgtcagatagcaaacaatgggaagtatatttttataaccgagcaacatctctacggaacagcgttatcggtatacaagtactctatatctttcaaacggtggctgttcgtgggctactcagacattagggccaaatacggtataaggagtgtcaaagatctctttgttggtaactgtccctctgtaaatagcccagtgctgacaattcttactgatgacaataacattcaaacaattcttcttaaataa

SEQ ID NO: 390 - protein, 461 aa, Saccharomyces cerevisiae
MGIPMQIYQDGKGVQFYHTRYQNVFDERASKYGNYTVNNDYPQLPDTIKEHIDQLTFSNVGEDGGDVGNYSEEDDDGDEEKELEDVFRSNRGLEFVRINNYFTTHDLQSFKSFRNFNSKYWIFYSNQAEDKKLLLYDFNGQHLIFIKQQFYGQLNLLLSDAIICMDCNFGYNSNTIQILVGFQNGKLLKLNCDLNGNVNNHLLLKDPSTSSHQSHLSILNVWAGLLPHFVVSFSLKDGLLITSLDHQQSNGSFQSFHTNIDLPVDLRTTTNVKSVLNFPQFTLYKGNDMIFHCKNLLGSDASTLNKEINFMLKIDEDVQKIDYLLKTNHILLETNMRYLSIPTRDPIENSNSSPPVSDSEVYPIFYKTQELHVHASGTGRQIANNGKYIFITEQHLYGTALSVYKYSISFKRWLFVGYSDIRAKYGIRSVKDLFVGNCPSVNSPVLTILTDDNNIQTILLK

SEQ ID NO: 391 - DNA, 689 bp, Saccharomyces cerevisiae
cagcagcgacaagtcagagtgcttacaaaaaaaaaagagttgatccggctaaagaaagtctgatttacgtatttatccaggttcaaacggattgccaaaaatagtcgataacctcggagtaagcaaagcaacaatatatttgttcttcgaaaaggtaaacttcttaacttctatagaagcattgtactagttctctcgaagaaaaaaactaagaaagctatagctgtatcttaccaagccatgaacttgaggaattggtaatccttattaggaaatacgctaaactaggtaatagcagatgatttactagcttactatctcacactaagtctggcaacgcgcttattttttaatacttttatacgaaccaatgaaatttgatcctcccctttttcgtctagttaaatgaagagatacaagtaggcctttctattgagtacttagcaagatatgtatttctaagaaacatcaacagtttcagcccacaaccgattcataaaatgtctgcctggaggaaagctggtatatcatatgctgcatatttgaatgtggccgctcaggctatccgttcttcattgaaaactgaattacaaaccgctagtgttcttaacagatcgcaaacagatgctttttatacccaatataaaaatggcactgcagcttctgaacccactccaataacaaaatag

SEQ ID NO: 392 - protein, 62 aa, Saccharomyces cerevisiae
MSAWRKAGISYAAYLNVAAQAIRSSLKTELQTASVLNRSQTDAFYTQYKNGTAASEPTPITK

SEQ ID NO: 393 - DNA, 1176 bp, Saccharomyces cerevisiae
acaaaccctgtcaatctcctgaaaaacaaaaattaagtgcttgagaagaccttcagaagagttgcatagataggatgggtgagcgcaattactagttacgcagtaagtaggttatatggctgctggaggggcagtactgatttaatcacaatccggattaaacttcctcctgaaaaaaaaaaaactacatcaagtcaaaagattttcattcactctttggaaggctgtgtggcattctaacctttatttttttatcaccattctcgaattttcgtggttcgctttcttagcgccgttattctctcttcttgtccacgtcaaagggagtatgcgtaacccctttcaaggttgaacgaaaaaaaaaaaaatatgtccttcaaaattttttttgatttaaaactaaaaaacattcccttgaagcttgttattccgaaagaaagaatctaaaattgcaattggtagtgaaaacaaataaacaaagacataaccgcactccaatcatgtccgaatatgcatctagtattcactctcaaatgaaacaattcgataccgtatgtaagatggttttattggttccatcgtcatcatggttcaaacagccaaatgacccgacacacgtaaccgaagcagttatactaacaagaaagctaattttcaccctccttgctacatttttttctacagaagtactctggtaatagaattttacagcaattagaaaataaaactaatttgcctaaatcttatttagttgctggtttaggtttcgcttatctccttttgatttttattaacgtcggaggtgtaggtgaaattctttccaattttgctgggtttgtgttgccagcatatttatcgttggttgctttgaagacaccaacgtccaccgatgacacacaactcttgacctactggattgtcttttcatttttgagtgtcattgaattctggtccaaggcaattctatatttgattccattctactggtttttgaaaaccgttttcttaatctacattgccttgcctcaaactggtggcgctagaatgatctatcaaaagatcgtagccccattgaccgacagatatatcctaagagatgttagcaagacagaaaaggatgaaattagagcttccgtcaatgaggcttctaaggctacaggtgcttctgttcattaa

SEQ ID NO: 394 - protein, 180 aa, Saccharomyces cerevisiae
MSEYASSIHSQMKQFDTKYSGNRILQQLENKTNLPKSYLVAGLGFAYLLLIFINVGGVGEILSNFAGFVLPAYLSLVALKTPTSTDDTQLLTYWIVFSFLSVIEFWSKAILYLIPFYWFLKTVFLIYIALPQTGGARMIYQKIVAPLTDRYILRDVSKTEKDEIRASVNEASKATGASVH

SEQ ID NO: 395 - DNA, 1613 bp, Saccharomyces cerevisiae
tagtgccatttgtggtcattattattccccaaatatgcgaaaatagtacactatttttggcaggagagtaggctgatatgccgcattgatgtcctgtgtagcgaaacacaaacaaaaaaagaaaaagtaggatgaaaaaaagaaaagtaatatgaaaaaagagtgaaaaattaattcatttgttagtgtaagcggtcaggtgtaagtagtaggcttgataatgaattaaagatgactccgacgcatattgtttgccatgtttttattttagtttgtagatttctttttttgtaatatataagggagtgattctatatatcgaattctcaggcttggttggttcgtaggttgttctgtctttgttttcgttaggtaagaacatcacacaaagataactatagaatcacatacatatttgtgagaaattaacttcatttcatttatagaagaagttcaaccgaaacaaaaattaaacataatataatataatataatcaaaaatggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 396 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHANVSTKEMRQPGGTKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 397 - DNA, 393 bp, Candida albicans
atggccccaaaagcagaaaagaaaccagcttccaaagctccagctgaaaagaaaccagctgctaagaaaaccgcttccaccgatggtgctaaaaagagaaccaaagctagaaaagaaacttattcctcatatatatataaagttttgaaacaaacacatccagacactggtatctcccaaaaggccatgtcaattatgaattcgtttgttaacgatattttcgaaagaattgccaccgaagcctccaaattagctgcttacaataaaaaatccacaatttccgctagagaaatccaaactgctgttagattaattttgccaggtgaattggccaaacatgccgtttccgaaggtaccagagccgtcacaaaatactcatctgcttctagttag

SEQ ID NO: 398 - protein, 130 aa, Candida albicans
MAPKAEKKPASKAPAEKKPAAKKTASTDGAKKRTKARKETYSSYIYKVLKQTHPDTGISQKAMSIMNSFVNDIFERIATEASKLAAYNKKSTISAREIQTAVRLILPGELAKHAVSEGTRAVTKYSSASS

SEQ ID NO: 399 - DNA, 732 bp, Candida albicans
atgagagacaaaaaacaaacaaaaaaaaaaaaatctttttttttcgccacgcacactaccatgtcgcaacaaccacatttacgtctcggatctaccgcacctgatttcaaagctgatacaactaacgggcctattctgtttcacgaatacattggtgatagctgggctatcttgttctcacatcccgctgcccacaccagtgtgtgtagcaccgagctttctgcgttcgcacgactcgaaccggagttcacgaagagaggggtgaaattgcttgcaatttcagccgaccctgttgaagcaaattccgactggattgatgatatggaagattttagcggatccagggtcaaatttccaattatcgcagaccctgagagaaaagttgctaccttgtacgacatgatcgatcaccaagatgccaccaatctcgatgacaaagggcttcaattgacaattcgtgcagtgtttatcattgatccaagtaagaaaatcagattgatcatgacctaccctgcctcgaccggtagaaacaccgctgaagtattgagagtactcgactcattacagcttgttgataaacaaaaggttatcactccaatcaattgggttccaggtgacgatgttcttgtccatatgggtgtcccagatgatgaggcaagagttttgtttcctaaatatagggctataaagccatatattagattgactccgttggaaaaggaagacaagtaa

SEQ ID NO: 400 - protein, 243 aa, Candida albicans
MRDKKQTKKKKSFFFATHTTMSQQPHLRLGSTAPDFKADTTNGPISFHEYIGDSWAILFSHPAAHTSVCSTELSAFARLEPEFTKRGVKLLAISADPVEANSDWIDDMEDFSGSRVKFPIIADPERKVATLYDMIDHQDATNLDDKGLQLTIRAVFIIDPSKKIRLIMTYPASTGRNTAEVLRVLDSLQLVDKQKVITPINWVPGDDVLVHMGVPDDEARVLFPKYRAIKPYIRLTPLEKEDK

SEQ ID NO: 401 - DNA, 981 bp, Candida albicans
atgaaattagccactgaaattgatttcaaactcaacaatggtaaaaccattcctgccttaggactaggtactgttgcctcaaaagatcctaaagatgttaaggatcaagtaatcactgctgttaaagcaggatatcgtcatattgatactgcttggttttatggtactgaaaaatatattggtgaagcattacaagaattatttgctgaaggaattattaaaagagaagatttatttatcacgacaaaattttggccatcatattgggctaatccagaaaaatctttagatgaatctttaaaagatttgcaacttgattatgttgatttatttttacaacattggccaatttgtttacatggtgatgaaaatggattaccgaaaatacctaaggatgagaatggtgaattgatttatgatgatgatccaaccccaaatggtactaaatatatcgacgtttatcataaattagaggatattttagaaacaaccaccaaagttagatcaattggtgtttctaattattcaattccaaaacttcgtcaattattacctaaagttaaaaaacatattcctgtttgtaatcaaattgaatatcatccacaattacctcaacaagatttagttgattattgtactaaaaataatatattgatttcttgttattcaccagttggtagttatggagctccagtattgaaaatcccattagttaagcaattggcagaaaaatatcaagtcacagagaatgaaattgctgatgcttataatattttgaatggtagagttacattaccaagatcttctaatcttgaaagaattaaaaccattattagattaccacatttgactaaagaagaattggatgaattgtatcaagttggagttaaagatccacaaagatatatttgtgatccttgggggtatggtataggattccgttggtggaaaggcgatactttaagtaaagaatttgattaa

SEQ ID NO: 402 - protein, 326 aa, Candida albicans
MKLATEIDFKLNNGKTIPALGLGTVASKDPKDVKDQVITAVKAGYRHIDTAWFYGTEKYIGEALQELFAEGIIKREDLFITTKFWPSYWANPEKSLDESLKDLQLDYVDLFLQHWPICLHGDENGLPKIPKDENGELIYDDDPTPNGTKYIDVYHKLEDILETTTKVRSIGVSNYSIPKLRQLLPKVKKHIPVCNQIEYHPQLPQQDLVDYCTKNNILISCYSPVGSYGAPVLKIPLVKQLAEKYQVTENEIADAYNILNGRVTLPRSSNLERIKTIIRLPHLTKEELDELYQVGVKDPQRYICDPWGYGIGFRWWKGDTLSKEFD

SEQ ID NO: 403 - DNA, 1389 bp, Candida albicans
atgaaaccaatgcaaaacgttaaggagtggtcagaaaaattgaaacaggaaggtaaagatgtacctcttgatttgaaagtgtatgaagatttgattagaaaggataaggaatttgtgggtaaattgaataaacagttgcatgacaacaaatttattatggaaaatattaacagagatatcaagtcttataatcaaatcaaacaattgaggatgaattctattgcgttgtccaacaaaggacagtataataacagtatttggggggaaggatatcaaggttatggcaatggaataacaaactccagtacaaagttatttattcccaacagggatttaactgatagaatcatcaatgaaagagtgatgaaaaacaaaaataaaccaaaacattatgtacccattcgattagagtttgaccaagaaagggatcaatttaaattgagagacacatttctttgggatttgaatgaagagattataaaagtggaagatttcactgctcaattgttagaggattataaatttatctccaaagttcattatgaaacaattttgtcatctattaaagagcagattgctgactatctgcagaaacctagcaaaacaatgggtgaattgagaattccaattaagatcgatatcaccattaacaatacacaattaactgaccaatttgaatgggatatattgaatagccaggaaggcgatgcagaagaattttcatcttacatgtgcgacgaattgtgtctaccgggagagttttgcactgccatcgcgcatagcataagagaacaatcgcagatgtactataaagcattgaatatggtagggtacggtttcgacggttcaccagtacacgaagatgagattagaaatcatttattgccacctttaagattagtatcatcggactctggaatcgtggatgattttttctcaattttaagaaacccatcaagtttgccagacttttcacctacgttaggtaaattgtcccaattggaagttgaaagattggacaaggaaatggagagagaaagtagaaggaaaagaagacacaattacaatgaagatcagcaacagggttctggtcgaggcttcacttcgagaagaattgcagctcatgctggtaggggaaacaccattcccgacttgtcagacatacccaagacatttaggacgcctgccccctcatccatattgccaggtgctgttgatatgggtgtacctgaggtgtatgaatataatgaagttttaatcaatagaactcaagttaggaatccagattatagaccgccaacacctattcgtgttgaaaatgaactagtggattataaccatgatccaattgaaggtacttttatggttacaatcaaattacccgtataa

SEQ ID NO: 404 - protein, 462 aa, Candida albicans
MKPMQNVKEWSEKLKQEGKDVPLDLKVYEDLIRKDKEFVGKLNKQLHDNKFIMENINRDIKSYNQIKQLRMNSIALSNKGQYNNSIWGEGYQGYGNGITNSSTKLFIPNRDLTDRIINERVMKNKNKPKHYVPIRLEFDQERDQFKLRDTFLWDLNEEIIKVEDFTAQLLEDYKFISKVHYETILSSIKEQIADYSQKPSKTMGELRIPIKIDITINNTQLTDQFEWDILNSQEGDAEEFSSYMCDELCLPGEFCTAIAHSIREQSQMYYKALNMVGYGFDGSPVHEDEIRNHLLPPLRLVSSDSGIVDDFFSILRNPSSLPDFSPTLGKLSQLEVERLDKEMERESRRKRRHNYNEDQQQGSGRGFTSRRIAAHAGRGNTIPDLSDIPKTFRTPAPSSILPGAVDMGVPEVYEYNEVLINRTQVRNPDYRPPTPIRVENELVDYNHDPIEGTFMVTIKLPV

SEQ ID NO: 405 - DNA, 597 bp, Candida albicans
atggcacaaggaaaagtagcaattatcatttattcattatatcatcatgtttatgatttagccttagctgaaaaagctggaattgaagctgctggaggtgttgctgatatttatcaagttgccgaaacattatctgatgatgttttagctaaaatgcatgcaccagcaaaaccagatattccaattgcaactcatgaaactttaactcaatatgatgcatttttatttggtattccaaccagatttggtaatttccctgctcaaattaaagctttttgggatagaaccggtggtttatgggctaaaaatgctttaagagggaaatatgctggtgttttcgtttctactggtactccaggtggtggtcaagaaactaccattattaatagtttgagtactttggctcatcatgggattatttatgttccatttgggtatggatatcctggtatgactgatttagaagaagttcatggtggatctccttggggggctggtacttttgcttcaggtaatgggtcaagaaaagttactgatttagaaaaagctattgctaaacaacaaggtgaagatttctttaaaactgtcttcaaatga

SEQ ID NO: 406 - protein, 198 aa, Candida albicans
MAQGKVAIIIYSLYHHVYDLALAEKAGIEAAGGVADIYQVAETLSDDVLAKMHAPAKPDIPIATHETLTQYDAFLFGIPTRFGNFPAQIKAFWDRTGGLWAKNALRGKYAGVFVSTGTPGGGQETTIINSLSTLAHHGIIYVPFGYGYPGMTDLEEVHGGSPWGAGTFASGNGSRKVTDLEKAIAKQQGEDFFKTVFK

SEQ ID NO: 407 - DNA, 450 bp, Candida albicans
atgataacaatgttaccattttcagcagatttgacagcagcatccaataaggatttagtaccgttggcgaatttttcaaattcgaaaacacctggtggaccgttccaaacaatggtcttagctttggcaacagcttgttggaacaattcgacagattttggaccacagtccaaacccatccagttgtctggaataccttcagcatcagtagcagaagaagttttggcatctttgtcgaatttatcagcagtgacaaaatcaactggcaagatcaattcaacattgtttttcttagctttttcaaccaagtgttcaacgtttttagcaccggcttcatcgaaaagagaatcaccaattggcattttgttcaagattttcttgaaagtgaaggccataccaccaccaacaatcaacatatcaaccttgtccaacaagttgtcaatcaattga

SEQ ID NO: 408 - protein, 149 aa, Candida albicans
MITMLPFSADLTAASNKDLVPLANFSNSKTPGGPFQTMVLALATACWNNSTDFGPQSKPIQLSGIPSASVAEEVLASLSNLSAVTKSTGKINSTLFFLAFSTKCSTFLAPASSKRESPIGILFKIFLKVKAIPPPTINISTLSNKLSIN

SEQ ID NO: 409 - DNA, 840 bp, Candida albicans
atggataggagttgggtagtaggttgtgccataaagggtggttgtttagttagttatggcacatgttgtggtagtttgatttttttttgtggtccacacgactggccaaacatttatcaaaaaatcgagttcaactttttttttttttccagttcgccaccaccaactacttttaccaccactaacaacatgtcaagagaagatccaattaaggctgaaaaagacttttctgctactttagatgaacaattcccattgattgaaaagatctctgactacaagcaagcattagataagtatcttgtcttggagaaacaaactcgtcagtcttccgatttggcttcatcaaaaagagttctcaacaagattgttactgcattggttgataataacgattgggagtatttgaatgacttgataactatcttgtcaaagaaacatggtcagttaaagtcgtcaattcaagcatttatcaaagatgtgattgataatttggataaattggatgaaaacaacaagcaacaattagagttgaagatgaaattgattgaaactattagaacagtcacagacaaaaagatttttgttgaagttgaaagagccattgtttcaagacagttggccaaaatttatttgaacaaattgaatgatttggataaggcagtggaaatcttgtgtgatctacaagtagaaacgtattcgttaatgccattcagtgacaagattgagtatatcttagaacaaattcagttgactttacaaaagggggactatggcccaagccaagattttgagtcgaaagattttattaaaatcgttgaagaactttgccaaagctga

SEQ ID NO: 410 - protein, 279 aa, Candida albicans
MDRSWVVGCAIKGGCLVSYGTCCGSLIFFCGPHDWPNIYQKIEFNFFFFSSSPPPTTFTTTNNMSREDPIKAEKDFSATLDEQFPLIEKISDYKQALDKYLVLEKQTRQSSDLASSKRVLNKIVTALVDNNDWEYLNDLITILSKKHGQLKSSIQAFIKDVIDNLDKLDENNKQQLELKMKLIETIRTVTDKKIFVEVERAIVSRQLAKIYLNKLNDLDKAVEILCDLQVETYSLMPFSDKIEYILEQIQLTLQKGDYGPSQDFESKDFIKIVEELCQS

SEQ ID NO: 411 - DNA, 1752 bp, Candida albicans
atgcaaaatactaaccgtaataatagtaatagtagtaagaataatagtgataatcatcatcaacaacaacaacgacaacgacaacaacaagttgatcaatatcaatctattacattaccaccattacaatatcaatctaatactcacgaatcgatagtattaccttcgcaacaacctaaaagaggtcgatctgaacattttaattcacaattccaacgtaatataaattcaagaccagtgttattaccaagttctcgtgataataataacaccacaaatatacctatacctataattttaccaagtagtaccaattctaacaatccaattacttctagtagcaattcaagaatgttttcacctaatcctgtgagtccattatatcccgtggtcaccacaccatcatcagcattatcaccaccaacacaacaccatcaacaacaacagcaacaattacataaaaaattcaaaacatcaaattcaggttccaatactccgattactggtggtggaattggatctcctagtactactagttatttagctaattctgctaatatcagttatactagaagtcaaccattaaaagataacaaccaaacatcttccacaactaaggataataataacacgataattgaaaatgaagaccagaagtttttccgattagcaaaagaagcattagtagctactgccaagggagttaagacgaatcattccaataataatggtaaatttggtaataatacttctaagattgatattaataatcataataagaacaacaacaacaaaagtgatggtaatgaaaccatacttgattctacaattgcagatttattaagaagattacaatatgctagtgctcctcatggtaatcccattggccaaataagtggacttcaaactaattctaaaggattacttgaagtacaagatgaatactctaatttccctgatttacaaaacaataattttttcaaagttaataatggtgataataataatactagtaatagcaagtttagtaataattatcatcatccatcaggtaatgaaccaggatggaattttttacttgatgaagcatcaacgaaaacaacatcaaacaatacacgatcaacaggaacaacaggaacaggaataggagcaacaaccaatataatatcagaatcagaatcggaattaaaagtgaaacgagaatcaagtattgccaatataatcaatccctcaacaacaacaacttccacaacaactaataagaataacaataacacttcatcatctactaaaactagaaaatattctcaagatccaacaagaaaatttccttgtgataaatgtcccatgtcatttcgtcgatcatcagatttaaaacgtcatgaaaaacaacatttaactatcccacctaatatttgtcaattttgtggtaaaggttttgctagaaaagatgctttaaaaagacatattgggactttaacatgtaaaagaaatgctgataagaaattatatattgaaaatttaaattatttaaataattcaagtcaagatgatgatgatgaagaggaggaggatgaagaagaagaagaaggattggaacaggatagattgtataagaagaggaggaagagtaataataataatcaaataattaaagaagaaggatttgaacataatgatgacgatgatgatgatgatgaagaggatgaagtgaaacgagaatttccaacttatggatatcaacagaattga

SEQ ID NO: 412 - protein, 583 aa, Candida albicans
MQNTNRNNSNSSKNNSDNHHQQQQRQRQQQVDQYQSITLPPLQYQSNTHESIVLPSQQPKRGRSEHFNSQFQRNINSRPVLLPSSRDNNNTTNIPIPIILPSSTNSNNPITSSSNSRMFSPNPVSPLYPVVTTPSSALSPPTQHHQQQQQQLHKKFKTSNSGSNTPITGGGIGSPSTTSYLANSANISYTRSQPLKDNNQTSSTTKDNNNTIIENEDQKFFRLAKEALVATAKGVKTNHSNNNGKFGNNTSKIDINNHNKNNNNKSDGNETILDSTIADLLRRLQYASAPHGNPIGQISGLQTNSKGLLEVQDEYSNFPDLQNNNFFKVNNGDNNNTSNSKFSNNYHHPSGNEPGWNFLLDEASTKTTSNNTRSTGTTGTGIGATTNIISESESELKVKRESSIANIINPSTTTTSTTTNKNNNNTSSSTKTRKYSQDPTRKFPCDKCPMSFRRSSDLKRHEKQHLTIPPNICQFCGKGFARKDALKRHIGTLTCKRNADKKLYIENLNYLNNSSQDDDDEEEEDEEEEEGLEQDRLYKKRRKSNNNNQIIKEEGFEHNDDDDDDDEEDEVKREFPTYGYQQN

SEQ ID NO: 413 - DNA, 516 bp, Candida albicans
atgtgtttatgtctttcggatttatttcttattattctttcagtattattcccaccattacctgtttggattagaagaggatgttgttcatgtgattcattaattaatattgccttatgtatgttaggatatttcccagggttaattcattcatggtatataatagctaaatattcttcttattattatcaacaacaacaacaacaacgtaaagataccatttattatgtttatcgaagtgatttagaaaatcaaacaccaagaagagatggcagagatgggagagatgaatgtcatcatgaccaccaccaccaccatcatcatcatcacaaccaggcagaatcacaaagtgcgggattaatagtttctaataatcataataataataataataactatggatctgtggttgaaggttcatcatcatcgaatttgactcctgtggctcctattcctgttgaaaatggagctccaccaccagcttatactgagattgataataaaacacaacattaa

SEQ ID NO: 414 - protein, 171 aa, Candida albicans
MCLCLSDLFLIILSVLFPPLPVWIRRGCCSCDSLINIALCMLGYFPGLIHSWYIIAKYSSYYYQQQQQQRKDTIYYVYRSDLENQTPRRDGRDGRDECHHDHHHHHHHHHNQAESQSAGLIVSNNHNNNNNNYGSVVEGSSSSNLTPVAPIPVENGAPPPAYTEIDNKTQH

SEQ ID NO: 415 - DNA, 333 bp, Candida albicans
atgccagctccatttgaaaaaggttcagaaaagaaaggtgccactttatttaaaactagatgtttacaatgtcacaccgttgaaaaaggtggtccacacaaagttggtccaaatttgcatggtgttttcggtagaaaatccggtttagctgaaggttattcttatactgatgctaacaagaagaaaggtgttgaatggactgaacaaaccatgagtgattatttggaaaatccaaagaaatatattccaggtactaaaatggcttttggtggtttaaagaaaccaaaggacagaaacgatttagttacttatttgaagaaagctacttcttaa

SEQ ID NO: 416 - protein, 110 aa, Candida albicans
MPAPFEKGSEKKGATLFKTRCLQCHTVEKGGPHKVGPNLHGVFGRKSGLAEGYSYTDANKKKGVEWTEQTMSDYLENPKKYIPGTKMAFGGLKKPKDRNDLVTYLKKATS

SEQ ID NO: 417 - DNA, 321 bp, Candida albicans
atgtcagcaggtattccagtaagacttctaaatgaagcacaaggtcatataatatcaatagaattgataaatggagatacataccgtgggaagctattagaaaatgaagataatatgaatttatccttatacgaggcaactataacacaaggcaaatcggggaaagtaagtcatatggaccaagtgtttataagagggtcaatgattagatttatatctgtgcctgatattttaaagaatgctcctatgttttttatgaaacctggagataaaccaaaacctccaataaggggccctccaccaaaaagaaagagagtatga

SEQ ID NO: 418 - protein, 106 aa, Candida albicans
MSAGIPVRLLNEAQGHIISIELINGDTYRGKLLENEDNMNLSLYEATITQGKSGKVSHMDQVFIRGSMIRFISVPDILKNAPMFFMKPGDKPKPPIRGPPPKRKRV

SEQ ID NO: 419 - DNA, 1239 bp, Candida albicans
atggttttaggcactccagacaagaatttgccttcaaagccagttgaaaaacaagtttttctcgaagatttgaataaaaatcaattggttaaagttagtaatgaacctagtgggttgaccaatttagggaacacttgttacttgaactcaagtttacaaacaatattccatattgatgatgtgaataacaggttgaaagattacacttttggtggagccaatcaagccaatagtgcctttgtgttgtcattgaaaagtatgttccagcaaatgtcgaaaaaacaagaagttataactccttctacatttctttctcttttcagaagatcttatcctcaatttgctgaacaacaaaatggtatttataaacaacaagacgccgaagaagcattttcccaaattttgagctctttgagaagcgaattgaaaatagatgatgtgttcaaaattacatttaacaccaagactcaatgcttggctattccagaagatgtcacagaagggtttgaagaagcatataaattgaattgtcatatcggcgtcaagaccaattttttgagagatggattgttggctggattaaaagaaacgattgaaaaacataattcaactttgaatgctgatactgagtatgaaacaaccaagaccataactagattaccaaaatacttgacagtacattttattagatttttctggaaacgagacatcaataagaaatccaagattttgagaaaggttcaattcccatttgaattagatttagcagaaatgttggatgtatcaataaaggcagataaagtttccaatagagatacaattagaaaagttgaaaaagataatttggatatgataagagatttcaaaaagaccaaaaatgacaccagtttaacaccattggaacaacaagaggaggatgagatgaaaataacatcaatcaagagtaagtttaaagacgacttgaatagcgctttgcccaacgttgattttaacaccaccacagaaaacccttctagtgtgtatgaattaaacgcagtcattactcatgctggatcatctgccgatggtggtcattataaagcatacgtcaaggatccaacagacttggatggcgagagatggtggttatttaacgatgataaggtgagctccgtaaacaaagaaaagatcgaaactttagctggcggtggtgaaagcgactcagctttattattgatttacaaaggcttagggctttag

SEQ ID NO: 420 - protein, 412 aa, Candida albicans
MVLGTPDKNLPSKPVEKQVFLEDLNKNQLVKVSNEPSGLTNLGNTCYLNSSLQTIFHIDDVNNRLKDYTFGGANQANSAFVLSLKSMFQQMSKKQEVITPSTFLSLFRRSYPQFAEQQNGIYKQQDAEEAFSQILSSLRSELKIDDVFKITFNTKTQCLAIPEDVTEGFEEAYKLNCHIGVKTNFLRDGLLAGLKETIEKHNSTLNADTEYETTKTITRLPKYLTVHFIRFFWKRDINKKSKILRKVQFPFELDLAEMLDVSIKADKVSNRDTIRKVEKDNLDMIRDFKKTKNDTSLTPLEQQEEDEMKITSIKSKFKDDLNSALPNVDFNTTTENPSSVYELNAVITHAGSSADGGHYKAYVKDPTDLDGERWWLFNDDKVSSVNKEKIETLAGGGESDSALLLIYKGLGL

SEQ ID NO: 421 - DNA, 834 bp, Candida albicans
atgtctttacaaaaactcactgcagaaatatactcactatttggaaaaggagattatcaaggttgccaacaattacttgctccgattaaactagaattagtcaaacatgatttgttggttcctttaccatccaacaccaccgataaaaaccaaattaatgatttgagaattgcccaaagaattttggaaattggagcattatcgtcattattaaccaacaactattccggttttgagaattattttgctcagttgagaccattttactctaaccccaaattacataatttacaaaaagtccatatcaataccgatataacaaaaatcatttcattatacttgttatacttgttgagtcagggtttgatttcaaaattccatgttgaactagaagtgatttataattcatcacaatatgatgcccaacaagacaagtatttacaatttccaataaatttagaaagcaatttaatggaaggtaattacataaaaatctggaagttattaaaagaagagaaaaacttaccatgtcaagaatacacccattttgttgatactttgataaatgctttacgttttgaaattgccaaatctttggagaaaacttacgattcgattccaatttctaattgcaagaatttattatatttaccacaagaattgtccgatgctaactttgagaaaactttaaaggaaacttatcaagttgataattggaaattcgaggatggagttatatatttcactaagaatgaaaatgaaaccaatgttgataaccaatcggttataaagaatttattagggtacgctgaacaaatcgaatccatcgtataa

SEQ ID NO: 422 - protein, 277 aa, Candida albicans
MSLQKLTAEIYSLFGKGDYQGCQQLLAPIKLELVKHDLLVPLPSNTTDKNQINDLRIAQRILEIGALSSLLTNNYSGFENYFAQLRPFYSNPKLHNLQKVHINTDITKIISLYLLYLLSQGLISKFHVELEVIYNSSQYDAQQDKYLQFPINLESNLMEGNYIKIWKLLKEEKNLPCQEYTHFVDTLINALRFEIAKSLEKTYDSIPISNCKNLLYLPQELSDANFEKTLKETYQVDNWKFEDGVIYFTKNENETNVDNQSVIKNLLGYAEQIESIV

SEQ ID NO: 423 - DNA, 354 bp, Candida albicans
atgtcatcatttaaaaaattcactgattttttattttcaaaacaatcccttagatatgtctgtacaactcatttttggggtccagtatcaaattttgggattcctatagctgctattttagatttgaaaaaagatcctgatttaattagtggaccaatgactggttcattaatactttattctttagtgtttatgaggtattcaatggcagttactcctcaaaattatttattatttgggtgtcattttgttaatgaattggcacaattgagtcaaggatttagatgggttaaacatcactatgatacttcttcaaatgatggtgaagataccaaaaagataactcaaaattga

SEQ ID NO: 424 - protein, 117 aa, Candida albicans
MSSFKKFTDFLFSKQSLRYVCTTHFWGPVSNFGIPIAAILDLKKDPDLISGPMTGSLILYSLVFMRYSMAVTPQNYLLFGCHFVNELAQLSQGFRWVKHHYDTSSNDGEDTKKITQN

SEQ ID NO: 425 - DNA, 4146 bp, Candida albicans
atgtcgagtaatagttcttggtctaacaacgattcttaccaactgaggaacaatcctaataatggtaataaccataacccacatttaatgtcacaacaacactcacaatctgtaaatattccttctcatttgttgcctcaagcatttatagaacaacaacaacaaccaccacaaccacaaccacaacaatatccgcaagacggccaagctcataacaaaaacccaccaatcaataatcgttttcatcaatcacaaccaccacaactgcgccatcaatacatcccatccaaacaagaacaaatgcaacaaccttacccaactgccgaacaaaataatcaacactttcctccaccacaggaaagatcatatagtttttcatcgactatggatcctggctcacctagcaaaatgacgccacctaatttttcacaaaggaaccaatcattttctggctaccaacaaccaccaccacaacaacaacagtatccgcagtcaccccataaggcatataaccaacaaacccacactcaccaaggtggacttcaacagccatacattgcgcaaagacaaaacatgccacctggatatattaaccagaatccatattctcagcaaaatagatcagtatcatctttgactcaagataggacaggagcaccagtacaacaccttccttatcctgtcaacaatgatgatcctggatatcaactacaaccactggcaattcaatcacaccacccaccacaacaacaacaacaacaacagcctccactccagacacgtagacaacttcgtaaggccccttcgagcaacttgcccccaattcaaactgatcaagtttactatagccctgatgctagaagaattgtttccacacctacacaccagcagaattttcccactcccataccaccagaagctagaacaaaatcacttacttcggcatcattaaaacaccagaaacaaccactgcaacctctgcaaccatatttccaacaaatctctgaactgccaggtaaagacagcaacgctcgtaattcctccagcagttcccttcatcatacattttccttaacctcaaaatcgcgatcatttacatctatcagtaaattgtcgtctttatcaactaagaaattcggttcctcttcatccgtcaataccaacaaattagatcgttatcaatccagtggaactattagaaacaatcacaatcataaccacaccaaccaaactagccacaacattcattatgctaaaccatcagtatatcccgcaattttatctgaagtggccaaattgtttaaagaggcgattattttgacgatcaacaccaaggatggtttggaataccatgatacttttaccgggaaaatggcagttgatatattatgtcgcattattcgaacaaatgatcgtaacttggccttgttattgggaagatcattagacgctcagaagtttttccatgatgttacttacaatcatagattaagggattcggtacatgaaatttatgcctttaacaatgtttataatgatgttgattttttcaacgaagaaaatggaggagctggtctggttagcaatggggaaaatagtgcattaaattccaaacatgggtcgtttcttgatagcagcacacagttacagaatgctttgaatgaccatatatccgattatcatacctcacaaagcagtggatcattaactaaaattgctagtagtgccactggtaatggttcagtaggtgttgctggtaaggagttgagtgcaagtcaacaaacaggtgttaatggagttttcactattttgacagaatgttattcgcccacatgtagcagaaatagtctttgttacagtattgcctgtccaagaagattagagcaacaagctagattaaatttgaaacctcaaggtggtttgcaacgtgctgtttcaaaattatcattgcatgatcaggaagaaaccgaaactttatggcacaagactgtacctcaatcagttttagataaattagacaagcatgaaaagactcgacaagaattgatttatgaatttgtttatactgaacgtgactacgtcaaggatttggaatttatgactgatttctacattatgccgttacgaaatcctgccaataatattattcctgattaccaaagagaaacatttattcaaactgtgtttgggggagtgcctgatttgttgagattggccaagagactcagtgaagcattaactcgaagacaacaacaacaaaagcccgttattgagaccattggtgatgtatttttagattatgttggtgattttgaaccttttgtgacatattctggaaataaagtgtttgctacttttgaacatgaaagacaacaacaagttaatatgaaatatgctagattcttagatgcgattgaaaagaaaccagaatcgagaagacaagatttatcatcttttttaattaaaggggttcaaagaccagcaagataccagttattgttatcgggtattttgaaacataccaagccagagtcacccgactacaagtatttgacgaaagcaaaagaagagattgagaaattattggtgaaaatcaatatccaaactggggaatgtactgatcgacacaaagtcatggttttgcataggttattgggcaaacaaactttggaaaataggtttaatttcaaattatcctacaataatcgtattatctatcaagtgactttgaatagaaagagggataacgaaaaaattgatttatacttgtttgaacatgcgttgttattagtgaaacacaagattcaaaacaagcgtgaacaacataaagtatttgaaaaaccaatgtatttaccattgttatttgtcaatagtggtatggagatccccactaatagaacaatcatgcctcatagataccatggatccttggtatctgatactagtataagacctcaaagagcagaatctaattatattggtaatactttgaattcttcatcaacacctaaattccaattgaatttttttgggttaggtagtaatcaagttcacgcctcattatttgctgatgacttgactattcagaaccaagtgttgctgcaaatatcggcccaacagaagaaattaattgatgctaatgacattttttcattgtgtaaatttgaaacgagaagattcactgggaataataaaatcaattgtgctgttccttgttatggtgggaagaaattgttgtatggtactgattcaggggtatgggttagtactgttcgttcaattagtgccacatctaatgaaaaaatctgtagtgatcccactatggtcatttccaaaacttatgtcactcaaattgaagtgattgttgaatactccaagttgttagtattgagtgacaaatcattatatgaatttgatttatcttgtaccgattctttggatcatgtgaagaataccaaactggggaaattgcttttgagtcatgtgtcatttttcaaagttggtgtttgtgatgggaaattgctagtgattggtgctagaacaggtagtctgcattcaatttgtatatttgagcctgttaatccatttgataaatcgaataagaataagaacaagagattagaaattcaagaaattaatttcagttctgatccaatttccatctcatttttgaagactaaactttgtattgggtgtgctaaaggttttgaaattttatcttctcaaacaggaaccaaagaatcgattttggatgaagcagacccttcattagattttgcaacacaaagagaaagtgtgacaccattagcaattcatcgattaggacgtgatttcttattgtgttattctgaatttgtatttttgatcaatcgaaatggatggagaacaaatcatgattgggggatattttgggaaggtaatccacaaaatgttgcgattttcttcccttacttgctatcatttgaacctggatttgttgaaattagagatttgcatacaactaatttattaagagctttaacgggagagaatattagatttttgcattcgaacgaacatgaagctatgtttgcttgtgaagaaaatggatatgatattattatttccattgatttcttgaatttgaaaccaaagtctccaacataa

SEQ ID NO: 426 - protein, 1381 aa, Candida albicans
MSSNSSWSNNDSYQSRNNPNNGNNHNPHLMSQQHSQSVNIPSHLLPQAFIEQQQQPPQPQPQQYPQDGQAHNKNPPINNRFHQSQPPQSRHQYIPSKQEQMQQPYPTAEQNNQHFPPPQERSYSFSSTMDPGSPSKMTPPNFSQRNQSFSGYQQPPPQQQQYPQSPHKAYNQQTHTHQGGLQQPYIAQRQNMPPGYINQNPYSQQNRSVSSLTQDRTGAPVQHLPYPVNNDDPGYQLQPSAIQSHHPPQQQQQQQPPLQTRRQLRKAPSSNLPPIQTDQVYYSPDARRIVSTPTHQQNFPTPIPPEARTKSLTSASLKHQKQPSQPSQPYFQQISESPGKDSNARNSSSSSLHHTFSLTSKSRSFTSISKLSSLSTKKFGSSSSVNTNKLDRYQSSGTIRNNHNHNHTNQTSHNIHYAKPSVYPAILSEVAKLFKEAIILTINTKDGLEYHDTFTGKMAVDILCRIIRTNDRNLALLLGRSLDAQKFFHDVTYNHRLRDSVHEIYAFNNVYNDVDFFNEENGGAGSVSNGENSALNSKHGSFLDSSTQLQNALNDHISDYHTSQSSGSLTKIASSATGNGSVGVAGKELSASQQTGVNGVFTILTECYSPTCSRNSLCYSIACPRRLEQQARLNLKPQGGLQRAVSKLSLHDQEETETLWHKTVPQSVLDKLDKHEKTRQELIYEFVYTERDYVKDLEFMTDFYIMPLRNPANNIIPDYQRETFIQTVFGGVPDLLRLAKRLSEALTRRQQQQKPVIETIGDVFLDYVGDFEPFVTYSGNKVFATFEHERQQQVNMKYARFLDAIEKKPESRRQDLSSFLIKGVQRPARYQLLLSGILKHTKPESPDYKYLTKAKEEIEKLLVKINIQTGECTDRHKVMVLHRLLGKQTLENRFNFKLSYNNRIIYQVTLNRKRDNEKIDLYLFEHALLLVKHKIQNKREQHKVFEKPMYLPLLFVNSGMEIPTNRTIMPHRYHGSLVSDTSIRPQRAESNYIGNTLNSSSTPKFQLNFFGLGSNQVHASLFADDLTIQNQVLSQISAQQKKLIDANDIFSLCKFETRRFTGNNKINCAVPCYGGKKLLYGTDSGVWVSTVRSISATSNEKICSDPTMVISKTYVTQIEVIVEYSKLLVLSDKSLYEFDLSCTDSLDHVKNTKSGKLLLSHVSFFKVGVCDGKLLVIGARTGSSHSICIFEPVNPFDKSNKNKNKRLEIQEINFSSDPISISFLKTKLCIGCAKGFEILSSQTGTKESILDEADPSLDFATQRESVTPLAIHRLGRDFLLCYSEFVFLINRNGWRTNHDWGIFWEGNPQNVAIFFPYLLSFEPGFVEIRDLHTTNLLRALTGENIRFLHSNEHEAMFACEENGYDIIISIDFLNLKPKSPT

SEQ ID NO: 427 - DNA, 966 bp, Candida albicans
atgctcattattgacaccaaaataatttcttcaccttttttttcttccttttctttcttcaagacaagcacagtttcttcccctctgctactgctaaacgtccaatcaaacactatgtcacaacgaattgcagattttgtttctaaaatagccttgccagctggtatcaccattgcattggcacaatcagccttgtatgatgttcctgggggtaagcgtgcagttatatttgaccgtttaaagggggtcaaacagggagttattggcgaaggtacccactttttggtgccatggttacaaaaggcagtgatatttgatgttagagttgaaccacgagtaattactaccactacaggatctaaggatttacagaatgtttcattgacattgagggtgttgagtagacccgaagtaagaaaattgcctactatttaccaaactttggggttggattacggggaaagggtgttgcctgccattggtaatgaaattttgaaatcgattgtggcacaatttgatgctgctgaattgatcacccagagagaggttgtttctgccagaataagacaagagttgtcaagaagagccgcagagttcaatatagaattggaagatgtgtcgattacacatatgacatttggtagagagttcaccaaagccgtggaaaagaaacaaattgcacaacaagatgcagaaagatcaaagttccttgtggagagagcagaacaggaaaagaaggctgcgattatcagagctgaaggggaggccgaatcagcagacgttgtttccaaggcgttggccaaagctggggatgggttattgatgatcagaagattggaggcatcaaaggacattgcatcaacattggccaactcaccaaatatcacttatttacctaatggtggcgctggcggcagcgatagcgacgggtccaaaaactcattattgttgaatattggccgttaa

SEQ ID NO: 428 - protein, 321 aa, Candida albicans
MLIIDTKIISSPFFSSFSFFKTSTVSSPSLSLNVQSNTMSQRIADFVSKIALPAGITIALAQSALYDVPGGKRAVIFDRLKGVKQGVIGEGTHFLVPWLQKAVIFDVRVEPRVITTTTGSKDLQNVSLTLRVLSRPEVRKLPTIYQTLGLDYGERVLPAIGNEILKSIVAQFDAAELITQREVVSARIRQELSRRAAEFNIELEDVSITHMTFGREFTKAVEKKQIAQQDAERSKFLVERAEQEKKAAIIRAEGEAESADVVSKALAKAGDGLLMIRRLEASKDIASTLANSPNITYLPNGGAGGSDSDGSKNSLLLNIGR

SEQ ID NO: 429 - DNA, 756 bp, Candida albicans
atgtcaagaagatacgattcaagaaccactattttttcaccagaaggtagattataccaagtggaatatgctcaagaagccatatccaatgctggtacagccatagggatattatctcctgaaggtgtcgttttagcgtgtgaaaagaaagtcacctccaagttattggacgatgatggatcagctgaaaaattatacattatcaacgatcaaatgatttgcgctgttgctggtatgactgccgatgcatcaattcttgtgaataatgcaagaattcaagcccaacagtatttgaagttgtacgacgaagagattccttgtgaaatgttgatcaatcgtgtttgtgatgtcaaacaaggttatacccaacatggtgggttgagaccatttggtgttagtttcctttatgccgggtatgatgacagatatcaattccaattgtttacatcgaatccttctggtaattacagtggttggaaggcaactagtattggtgctaacaattctgctgctcaaactttattgaagaaagattacaaggacgatttgactttaaaagatgcatgcgaattggctatcaaggttttatcaaaaactatggatgcttcaaacataaatagtgaaaaattagaattcgctaccttaagtttgggcaaagacaacaaagtgttgcataaaatttggaacgataaagatattgacatcctaattaaggcttcgggggttttgaacgaaaaaaatagcgatgatgaatag

SEQ ID NO: 430 - protein, 251 aa, Candida albicans
MSRRYDSRTTIFSPEGRLYQVEYAQEAISNAGTAIGILSPEGVVLACEKKVTSKLLDDDGSAEKLYIINDQMICAVAGMTADASILVNNARIQAQQYLKLYDEEIPCEMLINRVCDVKQGYTQHGGLRPFGVSFLYAGYDDRYQFQLFTSNPSGNYSGWKATSIGANNSAAQTLLKKDYKDDLTLKDACELAIKVLSKTMDASNINSEKLEFATLSLGKDNKVLHKIWNDKDIDILIKASGVLNEKNSDDE

SEQ ID NO: 431 - DNA, 1491 bp, Candida albicans
atgacatctacaaacaaaccaccagccttaaaagaagatattttagaacttattggtaatactccattagtcaaattgaacaaaattccacaatcgttgggaattaaagccaaggtctatgccaaagttgaattattcaatgccggaggatcaattaaagatagaattgccaaaaatatggtattggaagccgaaaaacaaggtaaaatcaaaccaggctatactttgattgaaccaacctcaggtaatactggtattggtttggctttggttggtgccgttcgtggatacagaaccatcattaccttaccagaaaaaatgtcaaacgaaaaagtttctgttttgaaagccttaggtgctgaaatcattagaactccaactgaagctgcatgggactctccagaatctcatattggtgttgctaaaaaattggaaaaagaaataccaaactctattattttggaccaatatggtaacccagccaacccagatgctcattattatggtactggttatgaaatttgggaacaaactgaaggtaaaattactcacttggttgctggtgctggtactggtggtaccatcactggtatttccaaatacttgaaagaaaaaaattctaagattcatgttactggtgctgacccaaaaggttctattttagctgaaccagaatctttaaataattccaccgaaggttacttggttgaaggtattggttatgattttattccagatgtgttgaacagaaaatatgttgatgattggatcaaaacagatgatgctgaatcttttaaattggctagaagaattattagagaagaaggtattttggttggtggttcttctggttctgccttacaagctgctttacaagtagctaaagacttgactgaagacgatactgtcgttgttgttttcccagattccatcagatcttacttgtctaaatttgccgatgacgaatggttaatctccaatggattcgaagttgaagattcaccgggtgctaacaaggctgacgaattcttgaatggtaagactatcaaggatttggttgctggcaaagctccagttgtcactgtcactttatctgacacagttgccaagacttttgatttattgcaatccaatgggtttgatcaattgccagttttgaataactctggaagattagttggtttgatcaccttatccaagatattgaaatctttatccactaaaaagattcaaacgaccaattcaatcagttcgatcatcattgatttcagaaagttggctgattttgaaaaatctttcaccatcactaaaaaatcaggattcactaagagaagttatgaaccaatcaagttggacaccccattagctgctttgaataaattctttgaaaccaattcaaatgctataatcacagatgatgaattgaaaccagttcaaattgttactaaggtcgatttgctttcgtatttgactaaaaacgctagtttttaa

SEQ ID NO: 432 - protein, 496 aa, Candida albicans
MTSTNKPPALKEDILELIGNTPLVKLNKIPQSLGIKAKVYAKVELFNAGGSIKDRIAKNMVLEAEKQGKIKPGYTLIEPTSGNTGIGLALVGAVRGYRTIITLPEKMSNEKVSVLKALGAEIIRTPTEAAWDSPESHIGVAKKLEKEIPNSIILDQYGNPANPDAHYYGTGYEIWEQTEGKITHLVAGAGTGGTITGISKYLKEKNSKIHVTGADPKGSILAEPESLNNSTEGYLVEGIGYDFIPDVLNRKYVDDWIKTDDAESFKLARRIIREEGILVGGSSGSALQAALQVAKDLTEDDTVVVVFPDSIRSYLSKFADDEWLISNGFEVEDSPGANKADEFLNGKTIKDLVAGKAPVVTVTLSDTVAKTFDLLQSNGFDQLPVLNNSGRLVGLITLSKILKSLSTKKIQTTNSISSIIIDFRKLADFEKSFTITKKSGFTKRSYEPIKLDTPLAALNKFFETNSNAIITDDELKPVQIVTKVDLLSYLTKNASF

SEQ ID NO: 433 - DNA, 384 bp, Candida albicans
atgaatcaaaataagaaattaactggtttaatattattagcgattatatcaatcattactttattcaactttaaaacaatttcccaaataactgccatcagatcatttgtctcccctgcctcttccaccgctactaatactaatactaaatcaacaatgtcagattccaaaggttacattatcactttgaaagatacttgtgctgattccgaagctagttcaattaaatcaaagattactgaattgggaggtaaaatcactaatgaatttagtttaatcaaaggattttctgctcaattgccaactatccatgctgaagctttacctaaagattttgctggtattgccaatattgaagaagatggtgaagttcgtacacaataa

SEQ ID NO: 434 - protein, 127 aa, Candida albicans
MNQNKKLTGLILLAIISIITLFNFKTISQITAIRSFVSPASSTATNTNTKSTMSDSKGYIITLKDTCADSEASSIKSKITELGGKITNEFSLIKGFSAQLPTIHAEALPKDFAGIANIEEDGEVRTQ

SEQ ID NO: 435 - DNA, 1212 bp, Candida albicans
atgacaatcgataacgaaggcattgtcattaaaccattgggttcaacaaaattattccaaccaataaaacttggttttaacactttatcacaaagaatagcatttgcaccatccacacgttatagagcaaccaaagataatatccctaccgatttacaattagagtattattctcaacgatcagaatatcctggaactttaatcattactgaagcaacttatacatcacgtcaaggtggattagtaccatatgttcctgggatttataatgatgctcaaactaaaagttggaagaaaattaatgatgcgattcatgccaatggaagtttcagttcagttcaattgtggtatttaggtagagttgctaatcctaaaaatttgaaagatgctggattaccatttgttggagcctcatcagtttattggaatgaagaaagtgaaaaattggccaaagaagctggaaatgaattgagggaattgacagaagaagagatcgatcacattgttgaagttgaatatccgaatgctgctaaacgtgccattgaagcaggatttgattatatcgaagtgcattcagctcatggttacttgttagatcaatttttaaatcttgcctctaataaaagaactgataaatatggttgtggtagtattgaaaatcgtgctcgtttattattaagaattattgataaattgattgatatagttggagctgaaagattagctatccgtttatcaccatgggccacgttccaaaatgttgacgtcgaaggagaagaaattcatagttatatcattgatcaattacaagaaagggcaaattctggtaatgaattagcgtatatttctcttgttgaaccacgtgttcaagcaagttgggatattgctaaagagaatcaagttggctcaaatgaatttattttgaaacattggaaggggaaagtaattagagcaggtacttatgctcatgaattaaataaaattaatgaagatattaataatgatagaactttaattgccttttcaagatttttcatttctaatcctgatttagtgaaaaaattacatgatgggatttctttgactccttatgaaagagcaacattttataatcatgataattttggatataatacttggattaaatatggagaaaataaagttttcaatgaacaagaagaaaggaaaaaattgggtaaacctttagcttag

SEQ ID NO: 436 - protein, 403 aa, Candida albicans
MTIDNEGIVIKPLGSTKLFQPIKLGFNTLSQRIAFAPSTRYRATKDNIPTDLQLEYYSQRSEYPGTLIITEATYTSRQGGLVPYVPGIYNDAQTKSWKKINDAIHANGSFSSVQLWYLGRVANPKNLKDAGLPFVGASSVYWNEESEKLAKEAGNELRELTEEEIDHIVEVEYPNAAKRAIEAGFDYIEVHSAHGYLLDQFLNLASNKRTDKYGCGSIENRARLLLRIIDKLIDIVGAERLAIRLSPWATFQNVDVEGEEIHSYIIDQLQERANSGNELAYISLVEPRVQASWDIAKENQVGSNEFILKHWKGKVIRAGTYAHELNKINEDINNDRTLIAFSRFFISNPDLVKKLHDGISLTPYERATFYNHDNFGYNTWIKYGENKVFNEQEERKKLGKPLA

SEQ ID NO: 437 - DNA, 1392 bp, Candida albicans
atgtcatctcctcaacaaattgtcaactcattccaacaagccttgaatttatcaggatctccaaatgctgtttctacatcaccaactcaatcattcttgagtcaatatgttccaagcaagccagctaaagctttgaaacctttcaaaactggtgatatcaaaattttattattggaaaatgttaaccaaactgccataaatattttcaaaaaccaaggttaccaagttgaattttataaatcatcattacccgaagatgaattattagagaaaatcaaagatgttcatgccattggtattagatcaaagactaaattaacagaaaaaatccttaaagctgctaaaaacttggtggttattggttgtttctgtattggtaccaatcaagttgatttggaatttgctgccaaatcaggtatcgctgttttcaactctccattttcaaattctagatcagttgctgaattagtcattgctgaaatcattactttggctagacaattgggtgatcgttcaatcgaattgcacactggtacttggaataaagtcagtgccaaatgttgggaaatcagaggtaaaactttgggtattgtaggttatggtcacattggttcccaattatctgtcttggctgaagctatgggtatgaatgttatctattatgatgtcatgaccattatgtctttaggtaactcgaaacaagttgaaagtttggacgaattgttgaaaaaagccgatttcgttactttgcacgtcccagctactccagaaaccaagaacttgttgagtgctccacaatttgccgctatgaaagatggtgcttacgttataaatgcttctagaggtactgttgttgatatcccagctttggttcaagccatgaaagccggaaaaattgctggtgccgctttagatgtttaccctcatgaaccagcaaagaatggtgaaggtttattcagtgatagtttgaatgaatgggccagtgaattgtgttcattgagaaatgtgattttgactccacacattggtggttctaccgaagaagcccaatctgctattggtattgaagttggtaattcattgaccaaatacatcaacgaaggtgcctctcaaggtgctgttaacttcccagaagtttcattgagaccattagatttggatcaacaaaatgttgtcagagtattatatatccatcaaaacgttcctggtgtgttgaaaactgtcaacaatatcttatccaatcataacattgagaaacaattctccgattctcaaggtgatattgcttacttaatggccgatatttctgatgttgatatcagcgatatacagtcattatatgaacaattagaacaaactccatataaaattgctactcgtttgttgtattaa

SEQ ID NO: 438 - protein, 463 aa, Candida albicans
MSSPQQIVNSFQQALNLSGSPNAVSTSPTQSFLSQYVPSKPAKALKPFKTGDIKILLLENVNQTAINIFKNQGYQVEFYKSSLPEDELLEKIKDVHAIGIRSKTKLTEKILKAAKNLVVIGCFCIGTNQVDLEFAAKSGIAVFNSPFSNSRSVAELVIAEIITLARQLGDRSIELHTGTWNKVSAKCWEIRGKTLGIVGYGHIGSQLSVLAEAMGMNVIYYDVMTIMSLGNSKQVESLDELLKKADFVTLHVPATPETKNLLSAPQFAAMKDGAYVINASRGTVVDIPALVQAMKAGKIAGAALDVYPHEPAKNGEGLFSDSLNEWASELCSLRNVILTPHIGGSTEEAQSAIGIEVGNSLTKYINEGASQGAVNFPEVSLRPLDLDQQNVVRVLYIHQNVPGVLKTVNNILSNHNIEKQFSDSQGDIAYLMADISDVDISDIQSLYEQLEQTPYKIATRLLY

SEQ ID NO: 439 - DNA, 486 bp, Candida albicans
atgtctcaattttacgaattagctccaaaagacgccaaaggtgaaccatatccatttgaacaattgaaagggaaagttgtccttatcgtcaatgttgcttccaaatgtggattcactcctcaatacaagggtttagaagaattgaataagaaatttgctgatcaaccagtacaaatcttgggtttcccatgtaatcaatttggccaccaagaaccaggtagtaacgaagaaattggatcattctgttcattgaactacggtgttacattcccagtcttggataaaattgaagtcaatggtgacaataccgatccagtttataaatatttgaaatcacaaaagagtggtgttttgggattgaccagaattaaatggaattttgaaaaattcttgattgaccaaaatggtaaagttattgaaagattcagttcattgactagtccagaaagtatcggtaccaagattgaagaattgttgaagaaataa

SEQ ID NO: 440 - protein, 161 aa, Candida albicans
MSQFYELAPKDAKGEPYPFEQLKGKVVLIVNVASKCGFTPQYKGLEELNKKFADQPVQILGFPCNQFGHQEPGSNEEIGSFCSLNYGVTFPVLDKIEVNGDNTDPVYKYLKSQKSGVLGLTRIKWNFEKFLIDQNGKVIERFSSLTSPESIGTKIEELLKK

SEQ ID NO: 441 - DNA, 849 bp, Candida albicans
atgtcatatcgattaatcaaactcaattccggtcataccattccatcaattggattaggatgttatgatatcccaagaaataaaacggtttcggtagtttatgaagcttgtaaagttggatatcgtcattttgatactgcagtgttatatggaaacgaagaagaagtcattgaaggtataagtaaattcttacgagagaaccccaatataccacgatctgagtttttttacaccacaaagctttggaataatcaattgggtacttcaagcactaaacaagccatttcaacaatgatggctcaagttggtgataaattagaatatattgatttattattgattcattctccattaccaggtaagaccaaacgtttagaaagctggaaagttttgcaggatgctgtggaaaaaggatggattaaaaacattggggtttctaattatggtaaacatcatattgaagaattgttgaccaatgcaacgatccctccagctgtcaatcaaattgaaattagtccttggtgtatgagacaggatttagctacttggtgtttaagtaaaggtatcaatgttgaggcatatgcaccattaacccatggtaacaaattacaagtcaacaatactgaatttcaagaaattatgcaaaagtataataaatcagctgctcaaatattgattaaatggtcattacaaaaaggttatataccattaccaaaaacaaaaactccatctcgattaaaggaaaatctttctgttgatgattttgaattgactaatgaagaaattaaggctattgatcaacctgatgcttatgaaccaacagattgggaatgtactgatgctccatag

SEQ ID NO: 442 - protein, 282 aa, Candida albicans
MSYRLIKLNSGHTIPSIGLGCYDIPRNKTVSVVYEACKVGYRHFDTAVLYGNEEEVIEGISKFLRENPNIPRSEFFYTTKLWNNQLGTSSTKQAISTMMAQVGDKLEYIDLLLIHSPLPGKTKRLESWKVLQDAVEKGWIKNIGVSNYGKHHIEELLTNATIPPAVNQIEISPWCMRQDLATWCLSKGINVEAYAPLTHGNKLQVNNTEFQEIMQKYNKSAAQILIKWSLQKGYIPLPKTKTPSRLKENLSVDDFELTNEEIKAIDQPDAYEPTDWECTDAP

SEQ ID NO: 443 - DNA, 603 bp, Candida albicans
atgaagatttattacattggtattttaagatcaagtggagacaaggctttagagttaacttcagccagagatttatcacagttttcctttttcgaaagaaatggggtatcccaattcatgacttttttcgcagaaaccgtatcccaaagaactcaacctggacagagacaaagtgttgaagaaggtaattatattggtcatacttataccagatcagaaggaatttctggtatcattataacggacaaagattaccctgtaagaccagcatatacattaataaataaaatcttggaagaatatttatcattgcatcctaaatctgattgggaaaacattgataaagcaaatgaaactttacaatatggacaattagaagcatatttgaaaaaatatcaagatcccactcaagctgattcaatcatgaaagttcaacaagaattagatgatactaaggttgttttacacaaaactattgaaggggttttacaaagaggagagaaattagattcattggttgacaaatcagaagcattgtcaagttcttcaagaatgttttataaacaagcaaagaaaaccaattcttgttgtgtgattatgtga

SEQ ID NO: 444 - protein, 200 aa, Candida albicans
MKIYYIGILRSSGDKALELTSARDLSQFSFFERNGVSQFMTFFAETVSQRTQPGQRQSVEEGNYIGHTYTRSEGISGIIITDKDYPVRPAYTLINKILEEYLSLHPKSDWENIDKANETLQYGQLEAYLKKYQDPTQADSIMKVQQELDDTKVVLHKTIEGVLQRGEKLDSLVDKSEALSSSSRMFYKQAKKTNSCCVIM

SEQ ID NO: 445 - DNA, 771 bp, Candida albicans
atggatgacaaagggtggagatttcctacaaaggaagaattgaagacattaaaaactgaagacgacatttcattaggtacacctgaccataactatgatttttcccgtcttagagaattgtactttaaggctgaaccagaatacgagggaagattcacagttccagtattgtgggacaaaaaagaaggtacaatcgtaaacaatgaatctgctgaaatcatcagaatgttgaatactgaattcaatagtattttgccaagtgaatatgccgaagttgatcttgttccaaaagacttagaatctcagattgatgaattgaacagctggatttacgataatattaacaatggtgtttataaagctggatttgcatccaagcaagaggtgtacgccaaagaatgtcaaaatgtgtttgatcatttggacaaagtggaagccattttggagaaaaaccacaatgggtccaagaagggagaatttttgttgggcaaccaattgactgaagcagatatcagattgtacacaacaattattagatttgatcctgtctacgttcaacactttaagtgtaatattggtacaatcagaactcactatccatacatccacaattggctcagattattgtattggaagattcctggtttccaagaaactaccaatttcgagcacatcaagtaccactacaccaaatctcatatcaagattaatccatacggtataacaccattgggtccagtaccaaatattttaccattggaagaaaagtaa

SEQ ID NO: 446 - protein, 256 aa, Candida albicans
MDDKGWRFPTKEELKTLKTEDDISLGTPDHNYDFSRLRELYFKAEPEYEGRFTVPVLWDKKEGTIVNNESAEIIRMLNTEFNSILPSEYAEVDLVPKDLESQIDELNSWIYDNINNGVYKAGFASKQEVYAKECQNVFDHLDKVEAILEKNHNGSKKGEFLLGNQLTEADIRLYTTIIRFDPVYVQHFKCNIGTIRTHYPYIHNWLRLLYWKIPGFQETTNFEHIKYHYTKSHIKINPYGITPLGPVPNILPLEEK

SEQ ID NO: 447 - DNA, 1287 bp, Candida albicans
atgggtgagtgtggctggggagagggaatatttagcagccagaggaaaaagagaccaagattcgtttttgggctcatctctctctctctctcttactcacacaaaagaagagctacgattaaagtttgcccaaatgggttggaaaaaaattttttttttaatttcttttttcacctcttaaagagtcaattattacaactactaccaatagcaaagatgagttccaatactcaagatttagttttagcttatattaatgattatgtttccagaaatgaagaattgtcaaagttgaagaaggcattatcgaaattcttagcaggcaaagaattaccaaaagtttctaaacagttggaatccattattgatgaagtggaaaatcaagaaaagaaaagcaaaccaagaaactcatcatctgatagtgaagactcttcatctgagagtgaaagctccacttcggacagcgaaagctcctcctcagatagcgacagctcttcctcagacagtgaaagttcttcctcagacagtgaaagttcttcatcagacagtgaagacagcgatgacgaggaagacaaggaagacaaggaagcagaaaaagataacaaagacagcgaagacagcgaaaacgaaaaagtggaagaagacaacaaagacaccagctctgattcaagttccagttccgactcaaaatctgattcagactcagactcaagctccagctctgattcaagttctgactctgattcaagttctgattccgactccagctccagctctgattccgactccagctccagctctgattccgattcagactcagattctgatagtgacagtgacgacaattcctcagaaagtagttctgaagacgaagaatcatctagtgattcagaatccaaagaggaacaaaaacaaccagaagacaagaaaagaaagcacacagatgatatcaaagaagaaaaaccagttaaaaagttcaaaaacgagtcagaatcatcagcatcatcttctactgattcaattcctgcaactccagaaccagaattaaagccaggccaaagaaaacatttttctagaatagatagaagtaaagttaactttgaaaattcagtattacaagacaatacttacaagggagctgcaggaacttggggagaaaaggctagtgaaaaattattacaagtcagaggtaaagatttcacaaagaataaaaataaaatgaagagaggaagttataaaggaggtagtatcactttagctagtgggtcctataaattcgaagattag

SEQ ID NO: 448 - protein, 428 aa, Candida albicans
MGECGWGEGIFSSQRKKRPRFVFGLISLSLSYSHKRRATIKVCPNGLEKNFFFNFFFHLLKSQLLQLLPIAKMSSNTQDLVLAYINDYVSRNEELSKLKKALSKFLAGKELPKVSKQLESIIDEVENQEKKSKPRNSSSDSEDSSSESESSTSDSESSSSDSDSSSSDSESSSSDSESSSSDSEDSDDEEDKEDKEAEKDNKDSEDSENEKVEEDNKDTSSDSSSSSDSKSDSDSDSSSSSDSSSDSDSSSDSDSSSSSDSDSSSSSDSDSDSDSDSDSDDNSSESSSEDEESSSDSESKEEQKQPEDKKRKHTDDIKEEKPVKKFKNESESSASSSTDSIPATPEPELKPGQRKHFSRIDRSKVNFENSVLQDNTYKGAAGTWGEKASEKLLQVRGKDFTKNKNKMKRGSYKGGSITLASGSYKFED

SEQ ID NO: 449 - DNA, 312 bp, Candida albicans
atggttcacgttgtcactgaagttaacgaattccaaacccttttaaaggaaaacaacttagttattgttgacttttttgccacttggtgtggtccatgtaaaatgattgctccattattagaaaaattccaaaatgaatattctaatattaaatttttgaaaattgatgttgatcaattgggttctttagcacaagaatataatgttagttctatgccaactttgattttattcaaaaatggtgaagaagtcaatcgtgtcattggtgctaacccagctgctattaaacaagctttggcttctcttgcttaa

SEQ ID NO: 450 - protein, 103 aa, Candida albicans
MVHVVTEVNEFQTLLKENNLVIVDFFATWCGPCKMIAPLLEKFQNEYSNIKFLKIDVDQLGSLAQEYNVSSMPTLILFKNGEEVNRVIGANPAAIKQALASLA

SEQ ID NO: 451 - DNA, 4938 bp, Candida albicans
  modified_base (2662): a, c, g or t
atgtcactgcctaacacgtcattccatagcgattcaaattttgaatcagctgtacaagatcttgaacaagagaagaaaatggtggcagccttaaagagactatctataggtcatatgatgcaatatgatcccgacttgccaccaggcagtatggatgatattgatccctttgcaaacaataacaacaacagcaataccgctagtaacaataaccactataatggtcataccagagatcacaccagcaacaacaacaatacacacaatcattctcccaactcaaaattgaaccaccatcgtggtcaaagtccttatgatgaagatttaattccacagaatatccacagatcacactcaactcgatcacgatcaaaatcacattcaacttctccttctacttcgcctcaacacaagcaacaacaacaacaacaaccgcaaccttttccacatgaaccacagactcctccatataacaaatcaccaagcccagtcaagagacgtagtttttacgacaattccagcgtgttgacgtcagaaagtcacgatatttttttcgatgccgaggatgaagtttatgatagttcatcccctttgttgtgggtaccagctaactctcatcctcaagtgaatcctgaatcgttcaagagtttaatcaaaactcaagtggaagagatattggaaagaaagctatctcgaaagtcaactatttcaagaaagtcaactttatcacgcagctcctcaaccagtaccaaagagacattagccccagaaccagaaataagtccagaactggaatgtgatgtgtcacctccttctccagtaagaaaatcttccttgtcttcgtcgtcacaacaaaatcaaaatgaagacgtttctcgaaaatcgtcgtcctcggtttcttcaacttctccacaaaaagatccagctaagagagaatcttggtacttcaacaactcaaaaagatacctgaatccatcattgcgagagctaacttcagaattggagcagttgtcaaaaatggcggggatggacaagaatgacgcagtaactttggcaagaactttgtcggcacaatcattggggtatacagatgtggaaaaattagcatttgacgaattagatagttcacaaacaaccgctactgcaacaacacccaattcactgggttctccaggaagttatgactctgcaaacccacctcgcaccacgaccttgcatttacaacaacgattacaacatcaatttcaacaagctcaaatcaaggcagaaagggaggcagaaagatcgacaagacatcaacaaagcgaacaacagtggccagtatcgaatgacgatagtcacaaatctctgtcacagttgacagcaagtgagggaggttctactgctaatgcttttaccagtgctgggagtggtgctgactttgccttgaaacgaagtagaagaactgattaccggaaaaaggaaacagattcgaaacaaaagacttcgaataattcgcctcctacaagaaagtacaatgtccggaattcccagttgttatttaactacaagaaaccagtagattctccttcgctgtcaccttcaccttcaccatctacatctcaaagcatgatgggtcacagggtgaaacacaagaaatctcaaaagccattggaagcagcattggctaacccaatgatggatggttcagatatgtcacataacccgtatcccactgcttcaaccactattgatttcagtcgtatgggtgctaagaaatcagccagacaatcacttagtccagagaatgcaatggatggcagatctcgaacaaagcccgaaaacaagactcatcgtggctatctgcatcaagaaaggtctcatccttatcatcaacaaccacagcctcaagtgcaacctcaaacccgccaacaacttccaccagcacaacaagctcatagacaatcgacgagacaaacccacaatcatccgagcacaggagttgaaaagcatcaccgacaggataacaagcgtgtaatgctgtcagcttctaatacagacataaatgattttatggctcaactgaatcaatttcagactaatggaacaagaaaccatcgatatgacaacctccataaaaaggataagactgcatttttgccaaatgaagaccaccaacgtaagtcccattcgacaagaaattcaaatgtaagaaatttgtcttcctcgtctcaacagcatttacatcaaccgtatctgacaacttctgttgcgcccaagtcacgtcaactacatcaaaatttagacaagttgagatccgagatcaatgaatttaaggaaagcttgaataaatcggaattacctggtgaggaatcaaaaagagaacacagactgcgtcacgaccagcaccaccaacaacgacaacgaccagcaccatcacagcaccaacttgagcctcgcaattacaaccacaatgaccgtcaccaaagacaacagcatgaacatgtacaaccccaacaagtccagcccttacagtcagatactagttttgatatcagttatcaagatttaagcgttgaagatcaattgggtattgaacaggaagcattgagagaattaggcaaggaaaaggggcattctcatgagattgatatagatgatgcatttgatgaaaatttaaaanttctgcctatcaatgaacgacatggctctcaattcacacttgatcatgacattttggacagctttaatttggtagataatcagttggttggatctgcagatgaaggaattgataatttgaagggtaagaatgaaatacccgttgggcgacaacaaccacaacaacaacgtcaacaaccaagagctgcttcgccaccatcctcacagcagtacttggggcatgatgaattgcacttgcaacaaggtaaagatacaaataaaaaagttggtcctcgtttaagtattgatacattgcagaacaagcctattcaccctgaggaaactgcaactggatttggaatgaatgcgttaccttcccctacgttgcatttagatgaatctcaaaatagcactcctggacatctgagaaaggcaagcaattctgcaagctacgacgattactataatatagccgacaaatcatctactgcgggtacccccaaaacaaagaaggagaccaaagttaaaacgaaattattcaataaagaccctaatttggagattatagactctgataactataaggaaaaaatgggcattgagacatctaacaataaaaaattgaaaaagaagaaatcttttggtttgcttagtacaacatcatctgtgggagcaaatgatacatctgaaaatgaagggcccaagaaattgaaaaagaaaaagtcgtggggctggttgcgggagcgttctgccagtgcctcgtctgcagatatcaacaatttgccgcctttgcctcttgataaactacctacaagatcattctcaaatcccgaaacgtcaactgaccaacaccagaaacatgatcttgagaacggttcagatcttgaacgtgaattggaacacgaacctgaacttgaacttgagttggagctggatcttgagtttgattacgagcaacaaagaaagcaccaagatgcttcaatggtaaatgattcaagctttgcagttgattctatctctatgaagtcgacagacaaggaaaacgtgctttccaaatttttcaagaaaaaggcaaaggtaccaggttcaagctcacagtcagtattttcatttgaatcaaaaggttcaggggccagcgtcgactatgaatcggacaacgacgcgaaactgatcaaaaagaagggcaacaatagcagcaggttattcaagaagaaatcaagggccaaattgtcagaacaagagaattcagtgaataaggaaaagcttcgacctttgaatttagtgtcaaacgaatcgcagacgatcgaggagaaagagaatttgcgacaaagtaatggcactcgtaaggcagaaagagttgagagtcaagagcaacaggaggaacagttccctgtaacctcgtcgccgatacatcaattcaacattgaacatctcaaagacgactttgtcactcttggggagaaggacgatgttttagattctggtactgatgacttggttgaagatgtaagatctcgtaacattcagagcacaatagttattgttgatgaggatgaaactcctattcaaaataacaatgataacaaagatttggggatgctaaaagttgacgaattgtccaaaaagaaatcaattagcaggaaaaaacggaacaatatgcaaaagaagaacctttctactgaacttactgatacaaacaaagaggtagtagaggaggttcttgcaactgagcaaagtgtcaaaccaagccaaggggaagatcttttgtctaagaatgaagataaagagaaattagatatccaagaaaagttgaagaaatcaataaaacgtacatcaagggccaaccagcctattgagtttactgattcagcctttgggttccccttgccaccaccatctcaatcaactttagtgatgcttgactacagatttccagttcatgttgagcgtgccatttatagattgtcacacttgaaacttgctaaccctaagcgttcactaagagagcaagttttgttgtcgaattttatgtatgcctacctcaacttagttgatcatacattacatttagagcaacaaaatatgagcagtgaggatggcgatcagatggaacgtgacgacgacgaagaagaagaaatgactgacactgatgagaaagacatgatttttggagagagtaatattgccgatgacgatgatcttattcctgaagaagcaaatggtgattcgattgggattaacttagatatggatggtttacataggaaacagcatcatcaatctggaatcgaagtatag

SEQ ID NO: 452 - protein, 1645 aa, Candida albicans
  MOD_RES (888): Variable amino acid
MSSPNTSFHSDSNFESAVQDLEQEKKMVAALKRLSIGHMMQYDPDLPPGSMDDIDPFANNNNNSNTASNNNHYNGHTRDHTSNNNNTHNHSPNSKLNHHRGQSPYDEDLIPQNIHRSHSTRSRSKSHSTSPSTSPQHKQQQQQQPQPFPHEPQTPPYNKSPSPVKRRSFYDNSSVLTSESHDIFFDAEDEVYDSSSPLLWVPANSHPQVNPESFKSLIKTQVEEILERKLSRKSTISRKSTLSRSSSTSTKETLAPEPEISPESECDVSPPSPVRKSSLSSSSQQNQNEDVSRKSSSSVSSTSPQKDPAKRESWYFNNSKRYSNPSLRELTSELEQLSKMAGMDKNDAVTLARTLSAQSLGYTDVEKLAFDELDSSQTTATATTPNSSGSPGSYDSANPPRTTTLHLQQRLQHQFQQAQIKAEREAERSTRHQQSEQQWPVSNDDSHKSSSQLTASEGGSTANAFTSAGSGADFALKRSRRTDYRKKETDSKQKTSNNSPPTRKYNVRNSQLLFNYKKPVDSPSSSPSPSPSTSQSMMGHRVKHKKSQKPLEAALANPMMDGSDMSHNPYPTASTTIDFSRMGAKKSARQSLSPENAMDGRSRTKPENKTHRGYSHQERSHPYHQQPQPQVQPQTRQQLPPAQQAHRQSTRQTHNHPSTGVEKHHRQDNKRVMSSASNTDINDFMAQSNQFQTNGTRNHRYDNLHKKDKTAFLPNEDHQRKSHSTRNSNVRNLSSSSQQHLHQPYSTTSVAPKSRQLHQNLDKLRSEINEFKESLNKSELPGEESKREHRSRHDQHHQQRQRPAPSQHQLEPRNYNHNDRHQRQQHEHVQPQQVQPLQSDTSFDISYQDLSVEDQLGIEQEALRELGKEKGHSHEIDIDDAFDENLKXSPINERHGSQFTLDHDILDSFNLVDNQLVGSADEGIDNLKGKNEIPVGRQQPQQQRQQPRAASPPSSQQYLGHDELHLQQGKDTNKKVGPRLSIDTLQNKPIHPEETATGFGMNALPSPTLHLDESQNSTPGHSRKASNSASYDDYYNIADKSSTAGTPKTKKETKVKTKLFNKDPNLEIIDSDNYKEKMGIETSNNKKLKKKKSFGLLSTTSSVGANDTSENEGPKKLKKKKSWGWLRERSASASSADINNLPPLPLDKLPTRSFSNPETSTDQHQKHDLENGSDLERELEHEPELELELESDLEFDYEQQRKHQDASMVNDSSFAVDSISMKSTDKENVLSKFFKKKAKVPGSSSQSVFSFESKGSGASVDYESDNDAKSIKKKGNNSSRLFKKKSRAKLSEQENSVNKEKLRPLNLVSNESQTIEEKENLRQSNGTRKAERVESQEQQEEQFPVTSSPIHQFNIEHLKDDFVTLGEKDDVLDSGTDDLVEDVRSRNIQSTIVIVDEDETPIQNNNDNKDLGMLKVDELSKKKSISRKKRNNMQKKNLSTELTDTNKEVVEEVLATEQSVKPSQGEDLLSKNEDKEKLDIQEKLKKSIKRTSRANQPIEFTDSAFGFPLPPPSQSTLVMLDYRFPVHVERAIYRLSHLKLANPKRSLREQVLLSNFMYAYLNLVDHTLHLEQQNMSSEDGDQMERDDDEEEEMTDTDEKDMIFGESNIADDDDLIPEEANGDSIGINLDMDGLHRKQHHQSGIEV

SEQ ID NO: 453 - DNA, 1332 bp, Candida albicans
atgtcatacaataacggaggatataataatagaaacggaggtagttacggtggaggctacggcggtggtggtagcagaggtggaagagatggctacagtggtggtggcagaggcggtggctacggtggtggtgatagagatcaaggtggatacagaggtggaagattcagtggtggtggccgtggtggtggtagatttaatgatgctccaagacaagaattaactgctccacaatgggatttagaacaattgccaaaatttgaaaaaaatttctattcagaacatccagatgttgctgccagatctgatagagacattgaacaatttagaaaagaaaatgaaatgacagttaaaggtcatgatatccctcatccaatcaccacttttgatgaagctggtttcccagattatgttttacaagaagtcaaagatcaaggtttccctaaaccaactcctattcagtgtcaaggttggcctatggctttgagtggtagggatatgattggtattgccgccactggttccggtaaaactttatcttattgtttaccatctattgtccatattaatgctcaaccacaattacaatatggtgatggtccaattgttttggttttagcaccaacaagagaattggcagtgcaaattcaaactgaatgttccaaatttggtaaatcatcaagaattagaaacacttgtgtttatggtggtgcaccaaaaggtcctcaaattagagatttagccagaggggttgaaatttgtattgccactccagggagattaattgatatgttggaagctggtaaaactaatttgaaaagagtcacttatttggttttagatgaagctgatagaatgttagatatgggttttgaaccacaaattagaaaaattgttgatcaaattagacctgatcgtcaaactttgatgtggtctgctacttggccaaaagaagtgcaacaattgactagagattatttgaacgatcctattcaagtcaccattggttcattggaattggctgcttctcatactattactcaattggttgaagtcattgatgaattttccaagagagatagattagtaaaacatttggaatccgctttaaatgaaaaagataacaaaatattggtttttgcttctactaaaagaacttgtgatgaaatcaccacttatttaagatcagatggttggccagcattagccattcatggtgataaagagcaaaatgaaagagattgggttttagatgaattcagaaagggtaaaacttctattatggttgcaactgacgttgctgctagaggtattggtatgtataatttttaa

SEQ ID NO: 454 - protein, 443 aa, Candida albicans
MSYNNGGYNNRNGGSYGGGYGGGGSRGGRDGYSGGGRGGGYGGGDRDQGGYRGGRFSGGGRGGGRFNDAPRQELTAPQWDLEQLPKFEKNFYSEHPDVAARSDRDIEQFRKENEMTVKGHDIPHPITTFDEAGFPDYVLQEVKDQGFPKPTPIQCQGWPMALSGRDMIGIAATGSGKTLSYCLPSIVHINAQPQLQYGDGPIVLVLAPTRELAVQIQTECSKFGKSSRIRNTCVYGGAPKGPQIRDLARGVEICIATPGRLIDMLEAGKTNLKRVTYLVLDEADRMLDMGFEPQIRKIVDQIRPDRQTLMWSATWPKEVQQLTRDYLNDPIQVTIGSLELAASHTITQLVEVIDEFSKRDRLVKHLESALNEKDNKILVFASTKRTCDEITTYLRSDGWPALAIHGDKEQNERDWVLDEFRKGKTSIMVATDVAARGIGMYNF

SEQ ID NO: 455 - DNA, 1032 bp, Candida albicans
atgtcaacaccaattactgttattgtttctggagccacaggatttattgctcaacacgttgttaaacaattattagctaaaaactatcaagtcattggtacagttagatcaacagccaaaggtgatcatttattaaaattattcaacaatccacaaaacttatcttatgaaattgttgaagatgttggaactaaaggtgcctttgataaagtattacaaaaacatggagaagcaaaagtgttcttacatttagcttcaccattccattttaatgtgactgatgttgaaaaagaattgttattgcctgctgttgatggtactaaaaatgtattacaagcaatttataattttggtaacaatattgaaaaagtggttatcacttcatcttatgctgccattagtaccgcttctaaagaagctgataaaaatgcaattattacagaaaaggattggaatgaaatcagttggcaagatgctttacttaatccagttaatggatatcgtggatccaaaaaatttgctgaaaaagctgcttgggattttataaaatctaatgataatgttaaattttcattgtcgacaattaatccatcatttgtatttggtccacaatcatttggttcagaaattaaacaaagtttaaacacttctagtgaaatcattaattctattttgaaattgaaaccaaatgattcaattcctgcgtcaaaaggaggttgggttgatgtaagagatgttgccaaagctcatatcattgcctttgaaaatgaggatgccaaaaatcaaagaatattgttgaattcaggtagatttacatctcaatcacttgttgatattattaatgataaatttccagatttgaaagggaaaataccagttgatgaaccaggttcagataaatctgttattgctgaaagtttggctactattgatgataccaaatctcgtgaattattaggatttgaatattataaccttgaacaatcagtttatgatactgttgaacaaattgttaatgctcataagttgtaa

SEQ ID NO: 456 - protein, 343 aa, Candida albicans
MSTPITVIVSGATGFIAQHVVKQLLAKNYQVIGTVRSTAKGDHLLKLFNNPQNLSYEIVEDVGTKGAFDKVLQKHGEAKVFLHLASPFHFNVTDVEKELLLPAVDGTKNVLQAIYNFGNNIEKVVITSSYAAISTASKEADKNAIITEKDWNEISWQDALLNPVNGYRGSKKFAEKAAWDFIKSNDNVKFSLSTINPSFVFGPQSFGSEIKQSLNTSSEIINSILKLKPNDSIPASKGGWVDVRDVAKAHIIAFENEDAKNQRILLNSGRFTSQSLVDIINDKFPDLKGKIPVDEPGSDKSVIAESLATIDDTKSRELLGFEYYNLEQSVYDTVEQIVNAHKL

SEQ ID NO: 457 - DNA, 546 bp, Candida albicans
atgtttgcatttaaaaaatctactacttcaattctcaaaacagtggtcgccccaacatcatctcgttatttatccaccgtcacattaagatcaatcccaagaacattccataatgccactaaagtttcattattcaatggattaagaactacaccaagattttatagtgtattgactgaatctccagaggcaaaagtatataaatatgccgatgttaaggatgtggccgtacaccctgaaaaccaccctgattctgttttagtggatgttagagaaccaactgaatttggagatggtcatataccaggagctttgaatattccatttaaaagtagtcccggcgcattggatttgtcagaagaagatttccaagaacattttggatttcctaaaccaagtactgataaagaattgattttctattgtcttggaggtgttagatctactgcagctgaagaattggccaatacttttggttataagaaaagaggaaattatcttggaagttgggaagattgggtaaaacatgaaaataaaaagaactaa

SEQ ID NO: 458 - protein, 181 aa, Candida albicans
MFAFKKSTTSILKTVVAPTSSRYLSTVTLRSIPRTFHNATKVSLFNGLRTTPRFYSVLTESPEAKVYKYADVKDVAVHPENHPDSVLVDVREPTEFGDGHIPGALNIPFKSSPGALDLSEEDFQEHFGFPKPSTDKELIFYCLGGVRSTAAEELANTFGYKKRGNYLGSWEDWVKHENKKN

SEQ ID NO: 459 - DNA, 702 bp, Candida albicans
atgtccatgatcaacagaattgcattgagaagtgctcgcccagccatgggaatggctttccgtccagccccaattggtttgagatacttgtctgctccagctgacccaaaacaaaaggccaattccatcattgatgcattaccaggtaacaacttattatctaagactggtgttttggctacttcagccgctgctgccatctatggtatttccaatggattatttattatacacgatgaaaccattttgcttgtcacttttgcaagtttcacagctttggtcgccaaattcgttgctcctttatacactgaatgggccgatggtgaaatcaaaaaagtcaacgatatattgaatcaatctagaactaaccatatcgaagccgttaacaagagaattgaaaccgtttcagaattaaaaaacgttgttgcaaccactgaagatttgtttgctttatctaaagaaaccgctcaattcgaagctgattcatttgaattaaaacaaaaattggctgtttctcacgaagctaaatctgttttggactcttgggttagatttgaacaacaacaaagacaattggaacaagaacaattggccaaagaagtcattgataaagttgacaaagaaattgctaatccaaaattccaagacaaagtattggctgaatctcttaacgaaatcgaaaaattgtttgctaaaaactag

SEQ ID NO: 460 - protein, 233 aa, Candida albicans
MSMINRIALRSARPAMGMAFRPAPIGLRYLSAPADPKQKANSIIDALPGNNLLSKTGVLATSAAAAIYGISNGLFIIHDETILLVTFASFTALVAKFVAPLYTEWADGEIKKVNDILNQSRTNHIEAVNKRIETVSELKNVVATTEDLFALSKETAQFEADSFELKQKLAVSHEAKSVLDSWVRFEQQQRQLEQEQLAKEVIDKVDKEIANPKFQDKVLAESLNEIEKLFAKN

SEQ ID NO: 461 - DNA, 2490 bp, Candida albicans
atgttgtccttaaagttgaaacatgcattgactttagctgattatggattgatcaatgaatcacagagatatattgatcatattaattctagtatcaagacattgggtaacaaatcaccttttgtcacgcctaatttgcttcatgagtttcagaatttgattatgagaatcactgaagttggatctggagatgatcaaaacaactggttttccggtaagattagtcgagtcaatcttgataagatctggggacaaattgataaatttattgttggtggagatgaactgaaaaatggtaacaataacgatggtaatggaactggcaatggaagtggtagtgttttcaataaatttagcccttccgtgtcgagaaatgcatcaagtgtgaatttacacaattatgtacaaccttcaatgattaggcaaccatcacatttaccatatcaaccacaacaacaaccgcaaccgcaacagcaattattggatcaagttcacattgaaagaaaacctacaactggattcactccgcaaccaccaccattagttggtcatccatcaacgacatcagttaataaatattctccaagtattaaatcgagtcctcgtcaagcacaactgaataagtttgaaaaatatgccccaagcaacaattcatctcatcataatcttagtcttgttgaagaaaggtcagctgttactagtgctgatggtcctgaataccctcaccaccaacaccaacagagtatcaatgcgtcaacagttcccgtgccacttccaccaccaacaccaccggtaagcatgccacaacatgtatctaggtctccacgtagccatcaactgcaccaaccaccaacattaccaccactgcattcacatcatgttcaacaaccatctagagatcggtcaccattagcgacacgaatctacccttatagcaatagtgttggcggacaaatttctactacgtcagtgggttctattcctagtcaaataccacttggtcgacagactcatgggaaacaaccttctatttcaagtgtaatttctggagatagtattgcagcagttggtttaggagaacaagagaatgttttacccccatcaaccggacaaacagggaaaacagctacaagtgaagtgaatagaaatgaggaaggttatggatttgggggtcactatcatcatgatcaacctgaaactataacggaatctccagaattaagaggcttacaacaaccacagtccagtgaagcagaaattagtaaagacatttcaaatgatgtagcattggatagtgctaagataccagaagcttcacaggaaccagaagaagaaacggacgaatcaggtaatgtggcagctgctccaccacctctacctgctccagttgcacctcctagaaaaacaaaatcttctagatctaatccatatgctccatctacagatattggtgctatcagtaatgcaccatcagcaataggacaaacacctagtgggaaaccaagtgtgagaaaatcaggatcaagaactaacagatatggaccaccaccaggagttggtaataaacaaccaactattgatgtttcgccaccttctgctactaataatactggtaatgaagattccattagtatgttttcctatggtgcctatcaaaatgagtctagtcctccactcaagcaaccgtcacaatttgatcagactgcagttgcatctgcccctgctccacatccattacaaccacaattggcggttccagaaagagttccaactaaaaatgtcgccaatattgatgatagttttgatgaaaatagtttagcagctgatacattaacaacttacaataataatatggtaaataaaccatatggactgtcaccaatgggaccaactgttgcaactaatggacctggatcagttactctgacacctttgattttaaatcaaggttctgcaaatatgaaattatcaaatctcagtactattagtgtcactggaactggagccggaactgttactgggactggtggagcattcgatggatttcctataccaggatcacctgatgaaactactcgaccaaattctatatttggtggtcatactagaggattattttcttcaagattatcagaatcacaaagtgtattatatcaacaatatgcaattgctgatgatacagttggtgattatattcctattatggaagaagatgatgaagatgatgaagatgaacaagctaagcaacagaaacaaaaagaaaaagaggcacaagaacaagaattgaagagaaagcaggaacaacaacaacaaaaagctgcagcaaagaataacaacaatagtggcggtggtggtggcaaattctttagcttattcggtggtggtggtaataataagaaacaagataatgatgctaaagtttataaagctcatttaggacaaaagaatacttttgtttatgatgaaaaattgaaacgttggatagattaa

SEQ ID NO: 462 - protein, 829 aa, Candida albicans
MLSLKLKHALTLADYGLINESQRYIDHINSSIKTLGNKSPFVTPNLLHEFQNLIMRITEVGSGDDQNNWFSGKISRVNLDKIWGQIDKFIVGGDESKNGNNNDGNGTGNGSGSVFNKFSPSVSRNASSVNLHNYVQPSMIRQPSHLPYQPQQQPQPQQQLLDQVHIERKPTTGFTPQPPPLVGHPSTTSVNKYSPSIKSSPRQAQSNKFEKYAPSNNSSHHNLSLVEERSAVTSADGPEYPHHQHQQSINASTVPVPLPPPTPPVSMPQHVSRSPRSHQSHQPPTLPPSHSHHVQQPSRDRSPLATRIYPYSNSVGGQISTTSVGSIPSQIPLGRQTHGKQPSISSVISGDSIAAVGLGEQENVLPPSTGQTGKTATSEVNRNEEGYGFGGHYHHDQPETITESPELRGLQQPQSSEAEISKDISNDVALDSAKIPEASQEPEEETDESGNVAAAPPPLPAPVAPPRKTKSSRSNPYAPSTDIGAISNAPSAIGQTPSGKPSVRKSGSRTNRYGPPPGVGNKQPTIDVSPPSATNNTGNEDSISMFSYGAYQNESSPPLKQPSQFDQTAVASAPAPHPLQPQLAVPERVPTKNVANIDDSFDENSLAADTLTTYNNNMVNKPYGSSPMGPTVATNGPGSVTSTPLILNQGSANMKLSNLSTISVTGTGAGTVTGTGGAFDGFPIPGSPDETTRPNSIFGGHTRGLFSSRLSESQSVLYQQYAIADDTVGDYIPIMEEDDEDDEDEQAKQQKQKEKEAQEQELKRKQEQQQQKAAAKNNNNSGGGGGKFFSLFGGGGNNKKQDNDAKVYKAHLGQKNTFVYDEKLKRWID

SEQ ID NO: 463 - DNA, 396 bp, Candida albicans
atgccaagtacaaaaagatcatcatctactgaatactcccataaagactctaaaaagaaagtcaaactagattatgtaaatctcaaaccatcacaaacgttatatgtcaaaaatctaaataccaaaatcaataagaaaattttattgcataatttgtacctattattttctgcatttggagatatcatttctataaatctacagaatggttttgcctttataatatttagtaatttaaatctggctacattggcgttgagaaatttgaaaaatcaagatttttttgacaaaccacttgtattaaattatgctgtcaaggaatctaaagctatttctcaggagaaacaaaaactacaagatgaaaatgatgaagaagtgatgccactgtatgaataa

SEQ ID NO: 464 - protein, 131 aa, Candida albicans
MPSTKRSSSTEYSHKDSKKKVKLDYVNLKPSQTLYVKNLNTKINKKILLHNLYLLFSAFGDIISINLQNGFAFIIFSNLNSATLALRNLKNQDFFDKPLVLNYAVKESKAISQEKQKLQDENDEEVMPSYE

SEQ ID NO: 465 - DNA, 3243 bp, Candida albicans
atgtatgcgacagcccatacaattaaacaacaacaacaacaacaacaacaacatccaccaccacctttaaacggtggactacatgcaagtggggctcctccaaattcccatgaagcagcagctattgctcagcaacaacaacaacagcagcaacaccacaatggtcctggtatgattgttgccgcagctgcagcttctgctaaccaacaagctgtccaagccagagcccaacaacaacaacagcagcaacaacagcgattacctagttcagctgctcttaatgaaactacagtatcaacttggttagccattggttcattagccgagagtttaggtgacattgaacgtgcgacagcttcttacaattccgctttgagacattcaccaaataacccagatattttagtcaaaatagcaaatacataccgttcaaaagatcagtttcttaaggctgctgaattgtatgaacaagctcttaatttccatgttgagaatggtgaaacttggggattattgggtcattgttacttgatgttggataatttgcaaagagcttatgctgcttatcaacgtgcattgttttacttggaaaaccctaacgttccaaaattgtggcacggaattggtattttatatgacagatatggctcattagaatatgctgaagaagcctttgtgagagttttggatttggatccaaatttcgacaaggctaatgaaatttatttccgtttagggatcatttataagcatcaaggtaaactacaaccagcattagaatgtttccaatacattttgaataatccaccacacccattaactcaaccagatgtttggtttcaaattggttcagtgtatgaacaacaaaaggattggaatggtgctaaggatgcttatgaaaaagtgttacagattaatcctcatcacgctaaagttttgcaacaattgggatgtctttattcccaagcagaatcaaatccatcaacaccagctaatggtgctgcaccaccacataagccattccaacaagatttgaccattgctttaaaatatttgaaacaatctttggaagttgatcaaagtgatgctcattcatggtactatttgggtagagtagaaatgattagaggtgatttcactgctgcttatgaagctttccaacaagctgtcaatcgagatgcaagaaacccaactttctggtgttcaattggtgttttgtactatcaaataagccaatatcgtgatgcattggatgcttataccagagccattagattaaatccttatatcagtgaagtatggtatgatttggggactttgtatgagacttgtaataatcaaattagtgatgcattggatgcatatagacaagcagaaagattggatccaaataatcctcatataaaggcaagattagaacaattgacaaagtatcaacaagaaggtaatactcacccacctcaaccaccgccaagttctcaacaacctagattacctcaaggaatggttttggaaagtactcaacaacaacagcaacaacaaccaccaccacctccacaacaacaacaacaacaacttcaacaccaactgcaactgcaacctcaaccacagcaaccacctcaaacccaatcacaaccactgttacttcaacaccaatcttcattgcctcctcaacaaatccaaccattacatcaacaagctgcaaagcctttagtgaatcaacaacaaagtccaccaccacctcacttgatgaacttgggacaaccggggcaacaaccacaacaattgccaccacatcttccaccacatacccagcaaccttctcaaattcaagaaaagcctccaactcaagaacaaccacattatcaaccacctccacctccacaacatcaacagcaatcgcaatcgcaaccgcaacctccacaccaacctcaacacactcaaaatcaactgcctcaattagctcaattgccaccacaccattctaatcctccagctaagccacatggtgcacctcaacaaagaactggtttaccggatttattacacaactctgctaatatcatatcagctccatcacaagtacctcaaccacaacaacaatatcaacaaccacatattgcacctgttagacaagaacaagttaaccatgttccttcaatttatctggctcctagaccaactgagacaacacttcctcaaatcaacaacccaaatgagtcaaccacaacacaagttccacaactcaaaaaggaggaacctaaaccagaggctactgtttctgctccagttcctgaggctattaaagttcaagatcaagtgacaatccaggagtcagcaccagcagcagcagcagcagtgtcagcaccagcttctgctccagttggtgatataaaaacagatactgtatctactactacacctgctacttcaaccactgcagatgctgtgccagtatctgtgtctcaagttggtgaagcaccaaatgttgttcaagagaagaaagttccggacaccgagcagatcgtttcacaagttgaaaaacccgtggagtcacaaccagaagttacaccagctccaacaccagctccagctcttgcaacagcaccaactgaacctgcacctactgataaggacgttgtaatggctccaagtaaaagtgcaacacctgttcctcaaagtattgtggaacagaacaccagagtatctgaagctacaaaggcaccagaatccaatggtaaacatgatttagaagacaagaatgatgaagaaaaaattttaaagaggccaactgttgaaacgactactgaatctgtaccagttaaccaacctgttgagaaagaaaatgaaaaagttgaggtaccaccgccactggaacaaccaagttcagaaaagagagaaaaagaagtcaacggatcaattaagaaaccattggaaaatgaaagtaaggttgatattcctcaattctcatcaaatatcacagctcaaaatgaagaagcaaaatctggagaagaaactaaaaaagatacaaccaagacaagtccagcaaaacaaggggaagttaaggaagtaataccatcatctacagaaactgtatcaaaaccagatgttgaaaaagacaataaagagaaagacaaagatgaagatgaagtgatggctgatgaagatgacgtcaaaaaagatgaaaatccagaacctccaatgagaaagattgaagaagatgaaaattatgatgatgaatag

SEQ ID NO: 466 - protein, 1080 aa, Candida albicans
MYATAHTIKQQQQQQQQHPPPPLNGGLHASGAPPNSHEAAAIAQQQQQQQQHHNGPGMIVAAAAASANQQAVQARAQQQQQQQQQRLPSSAALNETTVSTWLAIGSLAESLGDIERATASYNSALRHSPNNPDILVKIANTYRSKDQFLKAAELYEQALNFHVENGETWGLLGHCYLMLDNLQRAYAAYQRALFYLENPNVPKLWHGIGILYDRYGSLEYAEEAFVRVLDLDPNFDKANEIYFRLGIIYKHQGKLQPALECFQYILNNPPHPLTQPDVWFQIGSVYEQQKDWNGAKDAYEKVLQINPHHAKVLQQLGCLYSQAESNPSTPANGAAPPHKPFQQDLTIALKYLKQSLEVDQSDAHSWYYLGRVEMIRGDFTAAYEAFQQAVNRDARNPTFWCSIGVLYYQISQYRDALDAYTRAIRLNPYISEVWYDLGTLYETCNNQISDALDAYRQAERLDPNNPHIKARLEQLTKYQQEGNTHPPQPPPSSQQPRLPQGMVLESTQQQQQQQPPPPPQQQQQQLQHQSQSQPQPQQPPQTQSQPSLLQHQSSLPPQQIQPLHQQAAKPLVNQQQSPPPPHLMNLGQPGQQPQQLPPHLPPHTQQPSQIQEKPPTQEQPHYQPPPPPQHQQQSQSQPQPPHQPQHTQNQSPQLAQLPPHHSNPPAKPHGAPQQRTGLPDLLHNSANIISAPSQVPQPQQQYQQPHIAPVRQEQVNHVPSIYSAPRPTETTLPQINNPNESTTTQVPQLKKEEPKPEATVSAPVPEAIKVQDQVTIQESAPAAAAAVSAPASAPVGDIKTDTVSTTTPATSTTADAVPVSVSQVGEAPNVVQEKKVPDTEQIVSQVEKPVESQPEVTPAPTPAPALATAPTEPAPTDKDVVMAPSKSATPVPQSIVEQNTRVSEATKAPESNGKHDLEDKNDEEKILKRPTVETTTESVPVNQPVEKENEKVEVPPPSEQPSSEKREKEVNGSIKKPLENESKVDIPQFSSNITAQNEEAKSGEETKKDTTKTSPAKQGEVKEVIPSSTETVSKPDVEKDNKEKDKDEDEVMADEDDVKKDENPEPPMRKIEEDENYDDE

SEQ ID NO: 467 - DNA, 1536 bp, Candida albicans
atggaaaggttcaatcaaattagacaaaaactcactgaagttcaaaggagggttcagttgttggaacaaacaaagaaaacaggaaatgttactccagagcaaattcaacagattgataaagaaataattgaatgcaaggcaaagttccaacagtatcaaaaagtagggatttatattagaaatcagttggttcttcaagctaaagcacaacaacagagacaattgcaacagcgacagcaacaacagcaacagcaacagcaacagaataacaatctaaaatcagctcagaaccagaaccagaatcaaaaccaaaaccaaaaccaaaaccaaaaccaaaaccaaaaccaaatacaaggagtgcaatctgctggacaaacacctcagcaacagagcttttcgccacagttgcaggctgtacaacaacaacaatttatgggcaacctgcaacaacaacagcagcagcaacaacaacaacttagaaatgcgaataaaagtgcacttcaaggtcaagctccttcacaggcgccaactcctttacctgttcggccaacacctcagagtcaacctacagcacaagcgggtgttgcttcacaggcagctacaccaggatttcgagcttctcaacccacaccatcgcaaacttcgagaactggatcagctctacaacaaagggcaccaagtcgacaggcatcttctacaccgcaatctcaattccaaccaccattaccactggagagtcgacatccttctgcaactacatcagaaaagccacttccccaacaacctggaagcggaacagcgaagagtcctagtgttgctgctactcctgctcagaataatggcactgtaactgcccggtctgcatcacctgttgcaactactacagatagtgctacaactggacgctcaggaactccccaacaacaatcaaggtcacgatctggatcatcgttgaatttggctggcattacacgtcagtctgtcccatcattgccaatttcgagttctattaatgtaaaacagcccacaatcaccacatttaatagtatcaatgatacgagacccagtttgacgggaggagctgccaatcctatgagtattttattagatacaccagcgatcacaaaattgcctacttttgatatcgaaggagacactggtgtcattgattctagtaccagtggacgagttttaaataaacgaaaattaggtgatttgataaatacaataggtgttgatgaaggggatggtaagaccagtattgatgggaatgtggaggaatttttgttggatttggctgatgaatttattcattcagtgacaagttttgcttgtcggttagcaaaacatagaaaggtggatagtatagaggcaagagatgttcaactacatttggataagaattggaatatcaagattcctggttatgcaatggatgagattcgaaacacaagaaaaatacaacctagtaatagttatagtcagaaagtacaaggtgtcgaagtttcgaaagctgtgaatgatgataatgcttaa

SEQ ID NO: 468 - protein, 511 aa, Candida albicans
MERFNQIRQKLTEVQRRVQLLEQTKKTGNVTPEQIQQIDKEIIECKAKFQQYQKVGIYIRNQLVLQAKAQQQRQLQQRQQQQQQQQQQNNNLKSAQNQNQNQNQNQNQNQNQNQNQIQGVQSAGQTPQQQSFSPQLQAVQQQQFMGNSQQQQQQQQQQLRNANKSALQGQAPSQAPTPLPVRPTPQSQPTAQAGVASQAATPGFRASQPTPSQTSRTGSALQQRAPSRQASSTPQSQFQPPLPSESRHPSATTSEKPLPQQPGSGTAKSPSVAATPAQNNGTVTARSASPVATTTDSATTGRSGTPQQQSRSRSGSSLNLAGITRQSVPSLPISSSINVKQPTITTFNSINDTRPSLTGGAANPMSILLDTPAITKLPTFDIEGDTGVIDSSTSGRVLNKRKLGDLINTIGVDEGDGKTSIDGNVEEFLLDLADEFIHSVTSFACRLAKHRKVDSIEARDVQLHLDKNWNIKIPGYAMDEIRNTRKIQPSNSYSQKVQGVEVSKAVNDDNA

SEQ ID NO: 469 - DNA, 333 bp, Candida albicans
atgatgtcgttccaaagactgctgaaaatttcagagctttatgtactggtgaaaaaggttttggttacaaaggttctattttccacagagtcatcccacaattcatgcttcaaggtggtgatttcaccaactttaacggtactggtggtaaaagtatttacggtaccaaatttgctgatgaaaactttgtcaagagacatgacagaccaggtttgttgtctatggccaatgctggtccaaacaccaatggttcccaattcttcattaccaccgttccatgcccatggttggatggtaaacacgttgttttcggtgaagtcactgatggtttag

SEQ ID NO: 470 - protein, 110 aa, Candida albicans
MMSFQRSSKISELYVSVKKVLVTKVLFSTESSHNSCFKVVISPTLTVSVVKVFTVPNLSMKTLSRDMTDQVCCLWPMSVQTPMVPNSSLPPFHAHGWMVNTLFSVKSSMV

SEQ ID NO: 471 - DNA, 4257 bp, Candida albicans
atgatttcaccaactcaccagagtcaataccttaattattttgtcaacccagttttaatgactgagtccggagatattattgatagtgtcactggtacaacaacaacgacagcaaacatgtcaaatacaacaatagatgcgcctactcccgcctcgactaccaagaattataagcacaaaaaacagaataccaatactggaacatccatgtcgccaagtaattcaataaattcaacaaacaacaatgcagcagcagcagcagcgacaacaacaacgtcaaaaaagtccaaagacatcccattagagttgactgcatttggtacaaccccctctgggaaaccacgtttatttgtttgtcaagtctgtacaagagcatttgctaggttagaacatctacgtagacatgaaagatcacacacaaaggaaaaaccatttagttgtggtgtttgtcaacggaagtttagtcgtcgagatttattgctaagacatgcacagaaattacacgctggctgtactgatgcaataacaagattaagaagaaaatcaattaagaaatctcaggatggggacgatgatgatgacgatgatgacgacgatgaagaaatggcaaattctgaagacgaaaacgatcatgatgaatcgggcaatgcaagcacaaagaatggtaaaaaggataaaaaagatccaccaccggagttcaatttaaatttattcaatctgaaacaaaagccaactaaagcgaacacgacaaagtcaaaagtggctaaattatcaacaacgacatcaaggaaaaattcaaccaatcctacgagaaaaaactccagctctttgcacaagcaggttcttgatcaacgtcaaaaggctgccgttaatacaaaaattgtatcaagtaccaaaattgtatcaggtaccaatagtggagtgtcgataactccaacaaggtctagaagaggtgcatcattttctgctcaatcgggtgccaactatgccatcaacatacctgagtttaatgatatatatccacaatctgataatgttgaattttcaacccctcaattcttaccatcttcattggataatgaaatgacgtggctaaataatattccaaacattcccggattgtctgattctgtgtcggctgcaaacttgatgcgtcagaattccataacaaattcagcagatcatgtaacacctccagtaaacgtgagtcagcatgggtcattttctcatcaatcaacattttcagctaccgatatgggacaaacaagatccgaaagtgtaaacagtttaaacactccatttgatggttcctacatgatgccaacggtaacaataagcaatcaagaaatccaaaatggtgttgctgctcatcatcatcatcaacaacaacagcagcaccagcagcacaatcatcaacatcaaccaaatcagtctctgctcgggttatcgagaaatgacatgttaagtgaagatcactatggctattcattttatgatatcccggagaatattctcaatttcccaatggattctatatcaacaacttcaaatgcaatgtcttcgggcccaattcaaaactttaaaccattatcgcctatcacacaagaaattgaacatgagattactccaagaattgatggaagaattggggatttccaaaataacaacaataccaatgataatccgattcaccaaaatatcaattatgacttgaactttcttcatactattgatgatataggacaagatgttatttctaaatttatgccaggaggttactcgttttatggagacaataatgtgtcggcaacttcttcagctaatgactacaactcaccgaacaatattgtttcaccgagccaacaaaacaatcaatttgctcttcacaaccagtcgtcacatcctagtggtgcttcaccacatttaaaccaagcaatgatgaataaaatgaggttgcataactattctagcaacaaattattcactaatcatataagacacatgataaataaggcattgggtaaataccccataagcggcataatgacacctactataccctcaaatgagaaactagagttttatttgagtgttttcattcaatcatttttggcacacctcccatttatacatccttctaaattgaatgaatatgaaattatggccatgactggtaatgaagatataaacaatgaaagtgctagagtttgtttgccattattaacagcgaccatgggggccttgttggccaataacaaaaacgatgctgaacatctttatgaagcctcacgaagaacaatacacatttatctagagagtagaaaaacaaattctactaacgacaagaattacaagaatggtaaggataaaagctcatccggtaatccattatggttacttcaatcactaatgttgtctgttctttacggattattttcagataatgaaaataatgtttatattgttatccgtcaattgaacgccttaaactcattagttaagacatccataaaaaataaagggccaattttcttttcaaacaatggcgaagatgaagaactttataataagttaaattctcatgataatggtacttccttattttccaataatttgaatgatgaaatgcgatacaaaaataatataaacatgcaatctcaaacgagaatagtatttatcatttatcggttgacgaactttttgttgatgatgtacaatgtaccgttaactttctcaatcaatgatattaatcaattggcagtcacttccaaagatgaagaaactttatggaactttaaaaattatcaagagtttcaagagttttctcataagaataacaagactttagatgattatttgaataataagaatgagccaataattttccgcgaattattgttgacagttatcaaatttggtatttcagatagtaacatttcaccagagattgaaaagaaagttacacaccaattgcagaatctttgtaaatatggattcaattgtttggtgcatggtatatatgaaatcaaacaatatcaagagatgaaagaagtagatacattcaaagtgttggattatttaaccaagttttatcctacaaatgatggattggggttcaattgctttagattacctgccaataaagacttggaaaagattgattatgccttattagtagattttactaaaatttcatcgataatagatcttaaattgcttaaagaacaaagttggcttaaaaattatcaagatttaactcaaaattatcatcgtcttttggatgctcacagtactgggaatccacttaattcaattaatgattatgattatttgaaacttgctgattgttgtattctggtactcaaattgatattatttaaagttgaggattccaacagtaatagtagaaatcgaagcaaaaatgatccaacaaatgaaatcaataacaaactcaacaacaacaacaacaataacaatgatatgaataataataacagtaatggtgatcaattaatttctgcctttgatactgattttggatatttgaatatggataataatggttatgccaaaaaagaagaatttttacgattcactgatgatgagttgcgatatgataaagaaaacacgatgtcatattttgataaacatattaaacttgatatatttgaagaagttgagaaatcaagtaatttgatacaagcacaaatgttattccatgcattttccgtattatcgattttttcggtttatgttatgcgtaaaaatgataataattcatcaccatttgctaatactgatttaatatttgaattgaatcatagatatagtatggttcttagattattagaaagacttgaaacttttttgaaattgagatatcaaacatcagcaggaggagggggaggaggtgttaacaataacaataacaacgccttatctataaaattagaacaagaattcacaaacttgtatctttacaatgggaatgtattatcttcagatcataatacaaatacaaataccaccaatactattactactactactactacagacaatggtactaaacaaaatcagcatcattcacaagattttggattagaaaagactttatatatcttaaaaatgggagaaaatgttttgaattatatttatgatttaaatttaaaagtttgcgtatttaagaaattgggtgatagtttatcagaaattagaaaatatttaattgataatgaatctactttgaatggttaa

SEQ ID NO: 472 - protein, 1418 aa, Candida albicans
MISPTHQSQYLNYFVNPVLMTESGDIIDSVTGTTTTTANMSNTTIDAPTPASTTKNYKHKKQNTNTGTSMSPSNSINSTNNNAAAAAATTTTSKKSKDIPLELTAFGTTPSGKPRLFVCQVCTRAFARLEHLRRHERSHTKEKPFSCGVCQRKFSRRDLLLRHAQKLHAGCTDAITRLRRKSIKKSQDGDDDDDDDDDDEEMANSEDENDHDESGNASTKNGKKDKKDPPPEFNLNLFNSKQKPTKANTTKSKVAKLSTTTSRKNSTNPTRKNSSSLHKQVLDQRQKAAVNTKIVSSTKIVSGTNSGVSITPTRSRRGASFSAQSGANYAINIPEFNDIYPQSDNVEFSTPQFLPSSLDNEMTWLNNIPNIPGLSDSVSAANLMRQNSITNSADHVTPPVNVSQHGSFSHQSTFSATDMGQTRSESVNSLNTPFDGSYMMPTVTISNQEIQNGVAAHHHHQQQQQHQQHNHQHQPNQSSLGLSRNDMLSEDHYGYSFYDIPENILNFPMDSISTTSNAMSSGPIQNFKPLSPITQEIEHEITPRIDGRIGDFQNNNNTNDNPIHQNINYDLNFLHTIDDIGQDVISKFMPGGYSFYGDNNVSATSSANDYNSPNNIVSPSQQNNQFALHNQSSHPSGASPHLNQAMMNKMRLHNYSSNKLFTNHIRHMINKALGKYPISGIMTPTIPSNEKLEFYLSVFIQSFLAHLPFIHPSKLNEYEIMAMTGNEDINNESARVCLPLLTATMGALLANNKNDAEHLYEASRRTIHIYLESRKTNSTNDKNYKNGKDKSSSGNPLWLLQSLMLSVLYGLFSDNENNVYIVIRQLNALNSLVKTSIKNKGPIFFSNNGEDEELYNKLNSHDNGTSLFSNNLNDEMRYKNNINMQSQTRIVFIIYRLTNFLLMMYNVPLTFSINDINQLAVTSKDEETLWNFKNYQEFQEFSHKNNKTLDDYLNNKNEPIIFRELLLTVIKFGISDSNISPEIEKKVTHQLQNLCKYGFNCLVHGIYEIKQYQEMKEVDTFKVLDYLTKFYPTNDGLGFNCFRLPANKDLEKIDYALLVDFTKISSIIDLKLLKEQSWLKNYQDLTQNYHRLLDAHSTGNPLNSINDYDYLKLADCCISVLKLILFKVEDSNSNSRNRSKNDPTNEINNKLNNNNNNNNDMNNNNSNGDQLISAFDTDFGYLNMDNNGYAKKEEFLRFTDDELRYDKENTMSYFDKHIKLDIFEEVEKSSNLIQAQMLFHAFSVLSIFSVYVMRKNDNNSSPFANTDLIFELNHRYSMVLRLLERLETFLKLRYQTSAGGGGGGVNNNNNNALSIKLEQEFTNLYLYNGNVLSSDHNTNTNTTNTITTTTTTDNGTKQNQHHSQDFGLEKTLYILKMGENVLNYIYDLNLKVCVFKKLGDSLSEIRKYLIDNESTLNG

SEQ ID NO: 473 - DNA, 393 bp, Candida albicans; identical to SEQ ID NO: 397

SEQ ID NO: 474 - protein, 130 aa, Candida albicans; identical to SEQ ID NO: 398

SEQ ID NO: 475 - DNA, 1653 bp, Candida albicans
atgtcattagataattcaacagaaaaccgtgatttggaagaaaaggaagaaattccaaagaacgaacataacgaacaaggcgaacaaaacgagaacaatgagcatatacctactttggaagataaaccattgaaggaatatattggtattagtattttgtgtttccttattgcctttggtggtttcgttttcggtttcgatactggtaccatttctggtttcattaacatgactgactttttagaaagatttggtggtactaaagctgacggtactctttacttttccaacgttagaactggtttattgattggtttgttcaatgtgggttgtgccattggtgcattattcttgtctaaagtcggtgatatgtatggtagaagagttggtatcatgactgctatgatcatttatattgttggtattattgttcaaattgcttctcaacatgcttggtatcaaatcatgattggtagaattatcactggtcttgctgttggtatgttatcagttttgtgtccattatttatctcagaggtttctcccaaacatttaagaggtacattagtttattgtttccaattgatgattaccttgggtattttcttgggttactgtaccagttacggtactaagaaatattctgactccagacaatggagaattccattgggtttatgctttgcttgggccttgtgtttgcttggtggtatggtaagaatgccagaatctccacgttaccttgtcggtaaagatagaattgacgatgctaagatttcacttgccaaaactaacaaggtttctccagaggaccctgcattataccgtgaacttcaattaatccaagctggtgttgaaagagaaagattggccggtaaggcatcttggggtgctttaatcactggtaaaccaagaatccttgaaagagttattgttggaggtatgttgcaatcattgcaacaattgactggtgataactatttcttctactacagtaccaccattttcaagtctgtcggtttaaatgattccttcgaaacatctattatccttggtgtcatcaactttgcttccacttttgttggtatttatgccattgaaagattgggtagaagactctgtttattaactggttccgttgccatgtccatttgtttcttaatttactcattgattggtactcaacatctttacattgatcaaccaggtggtccaaccagaaaaccagatggtaacgctatgattttcattactgcactttatgttttcttcttcgcttctacatgggctggtggtgtctactccattgtttctgaactttatccattaaaagtcagaagtaaggctatgggttttgctaatgcatgtaactggttgtggggtttcttgatttccttcttcacttcatttatcactgatgctatccacttctattatggttttgtgtttatgggctgtttagtgttttccattttctttgtttactttatgatttacgaaactaaaggtcttactttagaggaaattgatgaattatactctaccaaggttgttccatggaaatcagccggttgggttccaccttctgacgaagaaatggttcgtgcaaaaggctatactggtgatatccacgcagatgaagagcaagtttaa

SEQ ID NO: 476 - protein, 550 aa, Candida albicans
MSLDNSTENRDLEEKEEIPKNEHNEQGEQNENNEHIPTLEDKPLKEYIGISILCFLIAFGGFVFGFDTGTISGFINMTDFLERFGGTKADGTLYFSNVRTGLLIGLFNVGCAIGALFLSKVGDMYGRRVGIMTAMIIYIVGIIVQIASQHAWYQIMIGRIITGLAVGMLSVLCPLFISEVSPKHLRGTLVYCFQLMITLGIFLGYCTSYGTKKYSDSRQWRIPLGLCFAWALCLLGGMVRMPESPRYLVGKDRIDDAKISLAKTNKVSPEDPALYRELQLIQAGVERERLAGKASWGALITGKPRILERVIVGGMLQSLQQLTGDNYFFYYSTTIFKSVGLNDSFETSIILGVINFASTFVGIYAIERLGRRLCLLTGSVAMSICFLIYSLIGTQHLYIDQPGGPTRKPDGNAMIFITALYVFFFASTWAGGVYSIVSELYPLKVRSKAMGFANACNWLWGFLISFFTSFITDAIHFYYGFVFMGCLVFSIFFVYFMIYETKGLTLEEIDELYSTKVVPWKSAGWVPPSDEEMVRAKGYTGDIHADEEQV

SEQ ID NO: 477 - DNA, 1641 bp, Candida albicans
atgtctcaagacaacgtctcatcaacatctacagctgaggctgtaaataatgaaatcaaagtcaaagatgaatttcgacaagaagaacaagctcatactagtttagaagataaacctgtgagtgcatacattggtatcatcattatgtgtttccttattgcctttggtggtttcgtttttggtttcgatactggtactatttccggtttcattaatatgtctgactttttagaaagattcggtggtactaaagctgacggtactctttacttttccaatgtcagaactggtttaatgattggtttgttcaacgctggttgtgccattggtgcattattcttgtctaaagtcggtgatatgtatggtagaagagttggtatcatgactgctatgattgtctatattgttggtattattgttcaaattgcttctcaacatgcttggtatcaagtcatgattggtagaattatcactggtcttgccgttggtatgttatcagttttatgtcctttgttcatttccgaggtttctccaaaacatttgagaggtactttggtgtgctgtttccaattgatgattaccttgggtatcttcttgggttattgtactacctatggtactaagagttactcagactctagacaatggagaattccattaggtttatgttttgcttgggctttatgtttggttgctggtatggttagaatgccagaatctccacgttaccttgtcggtaaagacagaattgaagatgctaaaatgtcacttgctaaaactaacaaagtttccccagaggacccagccttataccgtgaacttcaattaattcaagctggtgttgaaagagaaagattagccggtaaggcatcttggggtactttattcaatggtaaaccaagaatctttgaaagggttgttgttggtgtcatgttacaagccttacaacaattgactggtgataactatttcttctactacagtaccactattttcaagtccgttggtatgaatgattctttccaaacttctatcattattggtgttattaactttgcgtccacttttgttggtatttatgctattgaaagaatgggtagaagactctgtttgttaactggttccgttgccatgtctgtctgtttcttaatctattccttggttggtactcaacatctttatattgacaaaccaggtggtgctagtagaaaaccagatggtgatgccatgatctttatgacttcactttatgtgttcttctttgcttctacatgggctggtggtgtttactccattatttctgaactttatccattgaaagttagaagtaaggctatgggtttagctaatgcttccaattggacctggggtttcttaatttctttctttacttcatttattactgatgctatccacttctactacggtttcgtctttatgggatgtttagttttctccattttctttgtctactttatggtttacgaaactaaaggtcttaccttggaagaaattgatgaattgtactccaccaaagtccttccatggaaatcagctggttgggtgccaccttccgaagaagaaatggcaacctctacgggatatgctggtgatgccaaaccagaagaggaacacgtttaa

SEQ ID NO: 478 - protein, 546 aa, Candida albicans
MSQDNVSSTSTAEAVNNEIKVKDEFRQEEQAHTSLEDKPVSAYIGIIIMCFLIAFGGFVFGFDTGTISGFINMSDFLERFGGTKADGTLYFSNVRTGLMIGLFNAGCAIGALFLSKVGDMYGRRVGIMTAMIVYIVGIIVQIASQHAWYQVMIGRIITGLAVGMLSVLCPLFISEVSPKHLRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVVVGVMLQALQQLTGDNYFFYYSTTIFKSVGMNDSFQTSIIIGVINFASTFVGIYAIERMGRRLCLLTGSVAMSVCFLIYSLVGTQHLYIDKPGGASRKPDGDAMIFMTSLYVFFFASTWAGGVYSIISELYPLKVRSKAMGLANASNWTWGFLISFFTSFITDAIHFYYGFVFMGCLVFSIFFVYFMVYETKGLTLEEIDELYSTKVLPWKSAGWVPPSEEEMATSTGYAGDAKPEEEHV

SEQ ID NO: 479 - DNA, 1700 bp, Candida albicans
ctaaagtccaaagttggttcaatttttggcagaaaaaagaagaaggaaaaattcactggagctgattcaattgctgaagatgaatcattatctgaggtttctttgccacctacaagaactaggaattcatcggtgttgtctcgcagtaactcaactagaagatcttttattgaccgcttccatagagatgagtctagcactggcattagcagacaacatgagcagcaccagcagcctttgagtgatcctttgcctcacgcagagaagcctcaaccggaaattccccaatcaccagaagctccacaggccaaatcactagagcctgtatcagaagtactaaaagaactgttcccacctatgcaaaacgggtccgaaaggaaaggtgaaaatcagcagtcgagagttgatgtatcctctcaaaccttgtcaccagttactcctactcacgatggatttggtggttctgttaaaccattaccagaacctgttgattctccaaatgtgattaaatacaatgactcggacgactcttctacagaagaacgtagaggctcgttacttgaaaaacacaatttagaagtacaacctgtatcttccccattcactactcaaccgccagcacctgtgccacaagaatccagatctagacaaagcagtgatggcatttactcgtttgaagcgggtgatgattccaacccaatctcggctactccaagatccgagcaaaatgtgtttggacagatgccagacccaaatttgtctcctgaaaagactcttgctccaccaccaccaccttcgagaaaagttttgcaccatgaagaaccaactgtaagggattcagctcttttccacaatttacctgctgcctcccattctggaagagattcggtaatggctccattagcaagtcaagacaggggtcattcgttgttgaaaaatgatttcaaacacgaaaacttggcatccaccctcggattgagctcttctattgctgaagtcatcaatgccagctttaaggatggacagttgattaaatcacaagtagttggtgaagtggccttcaattataatggtaatgcttccgatccacttgtggtcactattcctaatagtttcgataaagtactcgtgaacaagacttttattgaggatttaggtcaaagcaagtataaagtgaacccaacttcaattacgtctaaaactcttggtgggttgaaatatcttttgaaaccaacacaggtaccagtgataattcaacaaatatggaaatttgaacctcatcagtcaagtttgatggttagcattcgttcaactacacctttggtattggaaaattttgttgtctctgtagctttgaatcaagacattgaagcaacatctgcttcctcaaagcctcaaggtgcgtttaataaagagaaaaacagaataacatggagatatccacagtccctcgcattgaatggtgtagagcgtttgatagctagatttatgactaatggattgggttccgaacatgagtctggtgtgcagattaaatttcaagttaaggatccacaagtcaagtactgtagtatttacagtgagaatggcgaagagattcctacgtttagaaatttggttagcggtagttatagtggtcatctttaagttatctgttttgagattagtctcttgttgaattgaaaaaaaaaaaaacgtga

SEQ ID NO: 480 - protein, 548 aa, Candida albicans
LKSKVGSIFGRKKKKEKFTGADSIAEDESLSEVSLPPTRTRNSSVLSRSNSTRRSFIDRFHRDESSTGISRQHEQHQQPLSDPLPHAEKPQPEIPQSPEAPQAKSLEPVSEVLKELFPPMQNGSERKGENQQSRVDVSSQTLSPVTPTHDGFGGSVKPLPEPVDSPNVIKYNDSDDSSTEERRGSLLEKHNLEVQPVSSPFTTQPPAPVPQESRSRQSSDGIYSFEAGDDSNPISATPRSEQNVFGQMPDPNLSPEKTLAPPPPPSRKVLHHEEPTVRDSALFHNLPAASHSGRDSVMAPLASQDRGHSLLKNDFKHENLASTLGLSSSIAEVINASFKDGQLIKSQVVGEVAFNYNGNASDPLVVTIPNSFDKVLVNKTFIEDLGQSKYKVNPTSITSKTLGGLKYLLKPTQVPVIIQQIWKFEPHQSSLMVSIRSTTPLVLENFVVSVALNQDIEATSASSKPQGAFNKEKNRITWRYPQSLALNGVERLIARFMTNGLGSEHESGVQIKFQVKDPQVKYCSIYSENGEEIPTFRNLVSGSYSGHL

SEQ ID NO: 481 - DNA, 1584 bp, Candida albicans
atgcagaggagattagtacagactgcttcgtatttgattagacgaaacaacgtggcatgtagattcagtcgttataatggtttgcccgttgcatcttattctacaaaaacagtaccttttacggcagatacttattcccaaaaagtccaacgtgatgcaaaattcaagcaacttgaatctcaagacatcgaatactttaaaagtgtattacctgagaattccattattactgatgaagacgacttattgtttttcaacgaagactggatgagaaagtatagaggtcaatcacaattggttttgaaaccgaaaaccaccgaacaagtcgcttctatcttaaagtattgtaatgataacaagctagctgttgtaccacagggtgggaatactgggttggtaggtggatctaatccaatttttgatgaaatcatcatttccttgtcggccatgaataaaatcagatcgtttgatcctgtcagcggtatattgaaagtcgacgctggtgttattttggaaacagctgatcagtatttggctgagcagggctacattttcccgctcgacttgggagctaaagggtcgtgtcatgttggtggcaatgttgcatgtaatgctggtggtttgcgtttgttacgatacggttctttgcatggttctgttttaggtttggaagctgtcttgcccgacggtacagtttataactctatgcattcattgcgtaaagataatactggttatgatttgaagcagttgtttattggatctgaaggtactttgggtattataactggtgtttcgattctatgtccatcaagaccacaagcgcaaaatgtggcatttttagctgtatcgagttatgaggccgttcaaaaggtttttgtccaggctagaaaggagttgcaagaaattttatcggcttttgaattcatggacaacacctcacaaaagttgactgctaagcatttaggtttggagcaccctattgaaagcggtgacttcccattctatgtgttaattgaaacctctggctccaacaaagagcacgacgacgaaaaattggaaacattcttggggaatgcaatggaagaaggtttagtcgacgatgggattattgcacaagatgaggctcaaatacaatcattatggtcatggagagaatccatccctgaagcaaccactattggaggcggtgtttacaagtatgacgtttctattccattggcagatctttacgggttagttgaggacatcaataccaggttaaatgatgctggaatcgccagcttggacgatgaatcgaaacttgtgcttgctgcattgggttatggtcacattggagatgggaatttacacttgaacgtttctgtgagaaagtattctcctgaaattgaaactatcttggagccatttgtctatgaatggatcgcaaaaaaaaatggatccatttcggctgaacatgggttgggattccaaaagaaaaactacattgggtattccaagaatgagattgaggtcaaattaatcaaagaaatcaaacaacattacgatccaaatggaatcatgaacccatataaatacgtgtaa

SEQ ID NO: 482 - protein, 527 aa, Candida albicans
MQRRLVQTASYLIRRNNVACRFSRYNGLPVASYSTKTVPFTADTYSQKVQRDAKFKQLESQDIEYFKSVLPENSIITDEDDLLFFNEDWMRKYRGQSQLVLKPKTTEQVASILKYCNDNKLAVVPQGGNTGLVGGSNPIFDEIIISLSAMNKIRSFDPVSGILKVDAGVILETADQYLAEQGYIFPLDLGAKGSCHVGGNVACNAGGLRLLRYGSLHGSVLGLEAVLPDGTVYNSMHSLRKDNTGYDLKQLFIGSEGTLGIITGVSILCPSRPQAQNVAFLAVSSYEAVQKVFVQARKELQEILSAFEFMDNTSQKLTAKHLGLEHPIESGDFPFYVLIETSGSNKEHDDEKLETFLGNAMEEGLVDDGIIAQDEAQIQSLWSWRESIPEATTIGGGVYKYDVSIPLADLYGLVEDINTRLNDAGIASLDDESKLVLAALGYGHIGDGNLHLNVSVRKYSPEIETILEPFVYEWIAKKNGSISAEHGLGFQKKNYIGYSKNEIEVKLIKEIKQHYDPNGIMNPYKYV

SEQ ID NO: 483 - DNA, 795 bp, Candida albicans
atgccagcctcccgtgaagattccgtttaccttgctaaattagccgaacaagcagaacgttatgaagaaatggttgaaaacatgaaagccgttgcttcctctggccaagaattgtctgttgaagaacgtaatttattatctgttgcttacaagaatgtcattggtgctcgtcgtgcttcttggagaattgtttcatcaattgaacaaaaagaagaagccaaaggaaatgagagccaagttgctttgatcagagattaccgtgccaagattgaagctgaattgtctaaaatttgtgaagatattctctctgtgttgagcgaccatttaattacatctgcccaaactggtgaatcaaaagtattttactacaagatgaaaggtgattaccacagatacttggctgaatttgctatcgctgaaaaacgtaaggaagctgctgatttatcattagaggcttataaagctgcttctgacgttgctgtgaccgagttgccaccaacccatccaatcagattaggtttagcattgaacttctctgttttctactatgaaattttgaactccccagatagagcttgtcatttagctaaacaagctttcgatgatgctgttgctgatttagaaaccttatctgaagattcatacaaggattcaactttgattatgcaattattgagagataacttgactttatggaccgatttatctgaagccccagctgccactgaagaacaacaacaatccagtcaagctccagctgctcaaccaacagaaggtaaggctgatcaagaatag

SEQ ID NO: 484 - protein, 264 aa, Candida albicans
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 485 - DNA, 1008 bp, Candida albicans
atggctattaaaattggtattaacggtttcggtagaatcggtagattagtcttaagagttgctttgggcagaaaagacattgaagttgtcgccgtcaacgatccattcattgctccagactatgctgcttacatgttcaaatacgattctactcacggtagatacaagggtgaagtcactgcttctggtgacgacttggtcattgatggtcacaagattaaagttttccaagaaagagacccagctaacattccatggggtaaatctggtgttgactacgttattgaatccaccggtgttttcaccaaactcgaaggtgctcaaaaacacattgatgctggtgccaaaaaagttatcatcactgctccatctgctgatgccccaatgtttgttgtcggtgttaacgaagacaaatacactccagacttgaagattatctccaatgcttcttgtaccaccaactgtttggctccattagctaaagtcgtcaacgatactttcggtattgaagaaggtttgatgaccactgtccactccatcactgctacccaaaagaccgttgacggtccatcccacaaggactggagaggtggtagaactgcttctggtaacattatcccatcttccactggtgctgctaaagccgttggtaaggttattccagaattgaacggtaaattgactggtatgtctttgagagtcccaaccaccgatgtttccgttgttgacttgactgtcagattgaagaaagctgcttcttacgaagaaattgctcaagctatcaagaaagcttctgaaggtccattgaaaggtgttttgggctacactgaagatgctgttgtctccaccgatttcttgggttcaagctactcatctatctttgatgaaaaagccggtatcttgttgtccccaactttcgtcaaattgatttcctggtacgataacgaatacggttactccaccagagttgttgacttgttggaacacgttgctaaagcttctgcttga

SEQ ID NO: 486 - protein, 335 aa, Candida albicans
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKLEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRVPTTDVSVVDLTVRLKKAASYEEIAQAIKKASEGPLKGVLGYTEDAVVSTDFLGSSYSSIFDEKAGILLSPTFVKLISWYDNEYGYSTRVVDLLEHVAKASA

SEQ ID NO: 487 - DNA, 399 bp, Candida albicans
atggcttcaacagttcaacacgcatccaaattccaacgttttttaaattcagagaccggtcctagaaccgtgcatttttgggctccagtgttcaaatgggccttagttgctgctggacttaatgacatacaacgtcctgttgaaaaattgagcggaacccaacagatagcattgtttgccactggtgccatatggactagatgggccgggtttgttataaaaccaaggaacatgcttttggcatcagtgaatttctttttgggtggagttgctggttaccaattgttaagaattgtcaactacagaagagatttgggtgattccccaatgcaagtatttaattatatcttgaacggtgatgcagctgctgtaaaagaaccagaaccagccaagaattaa

SEQ ID NO: 488 - protein, 132 aa, Candida albicans
MASTVQHASKFQRFLNSETGPRTVHFWAPVFKWALVAAGLNDIQRPVEKLSGTQQIALFATGAIWTRWAGFVIKPRNMLLASVNFFLGGVAGYQLLRIVNYRRDLGDSPMQVFNYILNGDAAAVKEPEPAKN

SEQ ID NO: 489 - DNA, 1224 bp, Candida albicans
atgttaagacaaccattacgccaaatccgtttccactcgaaattggcacttgcaggatacaacagcaaagaagtgacagtcaccatcaacggcagaacctgtacattcaacaacgtgtttttgagagacgcatgccaaagcccagactcggtagaccccatttctagccaaaaactattcactacagcagatgcagcaaccggcttgcaaattaacgcacccccagtggtagaggattcctcattgaaaatccaatggagcaacaatggcaaactcaccaactcagtctaccccgtgtcattcttagaaaactactccaccaacaaacgactcggcaaattctttgacaaagatagaaagttatgggacaaacaagaactcgaaaacaactttgcctccctcaacatggactacgacgacattctcaccaacgacaactctttcttccagacgttgtacaacttgaataggtacgggttaacatttgtcaacaacatccccaccccacaaatttctgacatgacagaggacaacgccacgcaatggccagtgtacaagatcgccgaaaagtttggctacatcaagaaaacattctacgggacattattcgacgtcaagaacaagaaggaaaaagcaaccaacattgcctacaccaacacgtttttgccattgcacatggacttgctctactacgagtcacccccgggattacagttgctacacgctatccagaactctacgttgggcggcgaaaacatcttctgtgactcgtaccttgctgctgagcatgtccggaaaaccgaccccagggcatacacggcactcacccagaccccaatcaccttccactacgacaacaacaacgagtactactactacaagcggccgttaatcgttgaagaccccgaggttggcgacgggttcccgaaaatcgcgtccatcaactatgccccgccattccagggcccattcgaggttgacccccacccagactttatccgcggaatgcagttattcgaaaccttcatcaacgacccggcaaaccactttgaaatcaaaatgccagaaggcacttgtgtcattttcgaaaacagaagagcccttcactcgagaaacgcattctccgacctgaacaacggcgacagatggttaatgggcacttatgttgacggcgacagttttagatcaaaattacgtataggctatagaaaagtacatacctaa

SEQ ID NO: 490 - protein, 407 aa, Candida albicans
MLRQPLRQIRFHSKLALAGYNSKEVTVTINGRTCTFNNVFLRDACQSPDSVDPISSQKLFTTADAATGLQINAPPVVEDSSLKIQWSNNGKLTNSVYPVSFLENYSTNKRLGKFFDKDRKLWDKQELENNFASLNMDYDDILTNDNSFFQTLYNLNRYGLTFVNNIPTPQISDMTEDNATQWPVYKIAEKFGYIKKTFYGTLFDVKNKKEKATNIAYTNTFLPLHMDLLYYESPPGLQLLHAIQNSTLGGENIFCDSYLAAEHVRKTDPRAYTALTQTPITFHYDNNNEYYYYKRPLIVEDPEVGDGFPKIASINYAPPFQGPFEVDPHPDFIRGMQLFETFINDPANHFEIKMPEGTCVIFENRRALHSRNAFSDSNNGDRWLMGTYVDGDSFRSKLRIGYRKVHT

SEQ ID NO: 491 - DNA, 354 bp, Candida albicans; identical to SEQ ID NO: 423

SEQ ID NO: 492 - protein, 117 aa, Candida albicans; identical to SEQ ID NO: 424

SEQ ID NO: 493 - DNA, 531 bp, Candida albicans
atgactgacggtaaattcccaactaacattgaaccaaaatacattccttattctaaagatcatgcaagtttaactgcttgtgctaatccaataccattggatttaaaatctttatttccaaataatactgttgttgtcactgctgtgcctggtgcttttaccccaacttgtactgaacaacatatccctgattatttgaaacatttgaaagatttcaaagacaagggcgtcaaaaaaatcattgttttatctgccaatgatccatttgtaatggcagcttgggctaaagctttgggttatactgatgaagaaaattatgttatttttgctactgatcctaatgcttctatttctaaagaattgggtgatggatttgttgctgatttgactctggcaggtatgggattaagattacaaagatatgctagtattgttgttaatggagaaatcacttatttggaaactgaagatagtttgggattcctggaaatttctagtgctgaaaccattttaaagagaatccacaattaa

SEQ ID NO: 494 - protein, 176 aa, Candida albicans
MTDGKFPTNIEPKYIPYSKDHASLTACANPIPLDLKSLFPNNTVVVTAVPGAFTPTCTEQHIPDYLKHLKDFKDKGVKKIIVLSANDPFVMAAWAKALGYTDEENYVIFATDPNASISKELGDGFVADLTSAGMGLRLQRYASIVVNGEITYLETEDSLGFSEISSAETILKRIHN

SEQ ID NO: 495 - DNA, 879 bp, Candida albicans
atgagaaaacaaaataacaatttattggatttgaatgatgaaacaccaccacaacaacctcaatattatttagcaaccggattctatcaacaacaaccacaattttatgcccagcaacctcaatcgcaacaattccaacaatatgatatgtttgggaacccaatacagaatccaatggacacaggattatataatcaacaggcctattatcaacaaccacaacagcagcaacaacagtttcaaccaaaccagtttactggttttaactatggacaaccacaacaaccacaagcgcaaccagaacctttacaaccattgaaaacaggatccaataatccatttgccatgtcttctgggtcagacaataccaacaagccaccaactcaatccttaaacagtttagctgaacagcaacaacagcaacagcagcagcaaccacaattttttactcagccaactactgctccactcaaacaacaaaacacatcatcatcaaggtttaatgaaactcatgagttgaatgatttattaactcaaggaactggattagatacattcggtaacactggagatactagaatcccacatcaacatacaaagacacaaaattttataaattcaagtggaactggatataaacaaactggtaatgaaccaattagattaagttctaatgctacaggtaatccatttcttaatactggtattggatatcaaggtgctacacaacagcaagtgccacaacagcaagtgccacaaatcaatcctgcttatactgggtatggatttggtaacgctcaacctcaacaacaccagcaataccaacaacaacaacaatcacgtaatggtaatgatggcccaagtttaatagatatttaa

SEQ ID NO: 496 - protein, 292 aa, Candida albicans
MRKQNNNLLDLNDETPPQQPQYYLATGFYQQQPQFYAQQPQSQQFQQYDMFGNPIQNPMDTGLYNQQAYYQQPQQQQQQFQPNQFTGFNYGQPQQPQAQPEPLQPLKTGSNNPFAMSSGSDNTNKPPTQSLNSLAEQQQQQQQQQPQFFTQPTTAPLKQQNTSSSRFNETHELNDLLTQGTGLDTFGNTGDTRIPHQHTKTQNFINSSGTGYKQTGNEPIRLSSNATGNPFLNTGIGYQGATQQQVPQQQVPQINPAYTGYGFGNAQPQQHQQYQQQQQSRNGNDGPSLIDI

SEQ ID NO: 497 - DNA, 789 bp, Candida albicans
atggctattaaagaagaaacaaatgaatttagtcaaggtaatgaggggaattcccattcaaccaataacaacaataacagcaacaacagcaacagcaacaacaatgctgatgtttctgcaccagtagatgatgacgatgatgacgatggtacttctcaaggtaaaactcaaaaggaaagaagaaaaattgagatcaaattcattcaagaaaaatcaagacgtcatattactttttcgaaaagaaaagctgggattatgaagaaagcttatgaattatcagtattgacaggtactcaagtgttattattagttgtttcagaaactggtttggtttatacttttaccactcctaaattacaacctttggtcactaaatctgaagggaagaatttgattcaagcatgtttgaatgctcctgaagaaggattgggtgatgatcaagagaatcaaagtgatggaaatacaggagattcacctgatcaaagccctgctccagcaaccaatccaaatgtcatgggtgctgcaggtcatgctcatcacattcaacaacaacaacagcaacaacaacaagctcaacagcaagctcagcaacaaatggcaccaatgccttctcatggtttacctacacattattccaatcctcaaggagctggtaatcctggtgtacctcctcaacaacaaggtcaacatcaacctggtattccattacaaggtggttatagtgatcaatacctgtattttggtaatattcaaaataacaacatacctaatcaacagcaatatcaatga

SEQ ID NO: 498 - protein, 262 aa, Candida albicans
MAIKEETNEFSQGNEGNSHSTNNNNNSNNSNSNNNADVSAPVDDDDDDDGTSQGKTQKERRKIEIKFIQEKSRRHITFSKRKAGIMKKAYELSVLTGTQVLLLVVSETGLVYTFTTPKLQPLVTKSEGKNLIQACLNAPEEGLGDDQENQSDGNTGDSPDQSPAPATNPNVMGAAGHAHHIQQQQQQQQQAQQQAQQQMAPMPSHGLPTHYSNPQGAGNPGVPPQQQGQHQPGIPLQGGYSDQYSYFGNIQNNNIPNQQQYQ

SEQ ID NO: 499 - DNA, 330 bp, Candida albicans
atgagaatgaaacaaccagacgaccaaaagtctgagagagagagagagaaaaaatatcggctcattattttcaattcacttttaatcctagttaatactatttactttctttcttctaactatccatcccaccatcctatctattcaattatgaatccacaaagaattattgaattacaaaaacattatcaaaatactcctaaaccattatggttaagaggtagacaatcggcatttttagtttatccattttatgctttatttgctgttagtactgccatcccattatattatagtgttagagctgttgctggtataaaagatgaataa

SEQ ID NO: 500 - protein, 109 aa, Candida albicans
MRMKQPDDQKSEREREKKYRLIIFNSLLILVNTIYFLSSNYPSHHPIYSIMNPQRIIELQKHYQNTPKPLWLRGRQSAFLVYPFYALFAVSTAIPLYYSVRAVAGIKDE

SEQ ID NO: 501 - DNA, 2091 bp, Candida albicans
atgccagataaacataaactcaaactatttggaaaaaataaacacgacaaagatgacgaattgtccttgtcaacgtcaaaccattctcacggaagtacacggaagtttttaggatttcatattggaagacatgaatcgggcgactcgttgacttctccagttatgagcaattcatccgaaagtcatcatcacagccatcaccctcatcaagccaattcaagtgcaaaccatcgtaacccttctccagttcattccaatactggtactgccactaccattccatcaatacaatcaccacaacctcaagcatctggattacaccgcggggactccgataaaaaatcatctggctcagttgttgatttgaaaaaattcttcaaaacaaagaaaacttcaaatccaagaaaggaaggacatagtattttgggacaatatagcaatcagctccattcaccaccaccaatggcgcaggttcattcgcctggtgcagggtcggggaacggcagtgccttgcaatcacgtgaacaatcatctacgtcattagccactttaatcaatcaaacatcttctcaacttttgtacaatgcttcacattctgtcaatagcaatcgagatcccttcacggacgacaactctccattggtgaagaagtatggtaagatcgggaaagagttgggcagtggagccggtgggtccgtcaaattaatcaccaggcccagtgactccaagacgtttgctgttaaagaatttagagcgaaaagatctactgaatcattgaaggattacactaggaaatgtactgctgagtattgtattggttctactttgaggcacccaaacatcattaaaaccatcgatattatccatgaaaacaatcgttattttgaaattatggaatatgcacctatagatttctttgctgttgttatgagtggagagatgtctcgaacggaaatcaattgttgtttaaagcaaattattgaaggtgtggcatatttacacaaattagggttggcccatcgtgatttgaaattggataattgtgttataacgaatgaagggattttgaagattatcgattttggtagtgctgtcattttcaagtatccctacgaacagtttggtaacaacaattctattcagccgtgtcatggtattgttggatctgatccttacttggcccccgaggttttgaaatctcctaatagctacaacccacaacctgtggatttatggtctattgccataatttactgttgtatgactttgaagagatttccttggaaaatacctagtcaagaaaaggataacagtttccgactttattgcatgtatgatgataatttccatgattattatttgagtaacgaatgtcataaacttttgttgcaacagcgtaaactaaagaatacaattgttagactgaacaaaaggaaaaagcagctagaagaggaaaagggcgacaagcctgaagaagacgaagaaatgaaagatgccgatagtgcaccacagcaacatcatcattctcatgatgtagagctgggaaaaactggtggatctacggttggcaaagacaagtcaaatgaagctgttaccgttttaacagatgagcaagcagaagagattatggcacaattaaatgagattgatagaaaactacaagagtttgaagataaaaagaatcaacttaaagagaaatatgaggctttgcgagatgctgatcctagatatcaaaaacagttggcacaaattcacgaagaggaagaaaagcaaagactaaaagatgccgagcacggtgccgatgagaaaaagaaatcacatcataaacagattcatggtccgtatagattgatgagattgttgccacatgctgctagaccagtcatatcaagattattggaggttgatccaaagaaaagagcaactatggaagaaattctagaagatgaatggattaaagaaattcaatgctgtacagttaagccagtttcaaaatcaacagatgcaacattagattttattgaggatgaggacgaagtattggtgaaaggagtacctccacacgagcatacaattgtgaaagaaggttga

SEQ ID NO: 502 - protein, 696 aa, Candida albicans
MPDKHKLKLFGKNKHDKDDELSLSTSNHSHGSTRKFLGFHIGRHESGDSLTSPVMSNSSESHHHSHHPHQANSSANHRNPSPVHSNTGTATTIPSIQSPQPQASGLHRGDSDKKSSGSVVDLKKFFKTKKTSNPRKEGHSILGQYSNQLHSPPPMAQVHSPGAGSGNGSALQSREQSSTSLATLINQTSSQLLYNASHSVNSNRDPFTDDNSPLVKKYGKIGKELGSGAGGSVKLITRPSDSKTFAVKEFRAKRSTESLKDYTRKCTAEYCIGSTLRHPNIIKTIDIIHENNRYFEIMEYAPIDFFAVVMSGEMSRTEINCCLKQIIEGVAYLHKLGLAHRDLKLDNCVITNEGILKIIDFGSAVIFKYPYEQFGNNNSIQPCHGIVGSDPYLAPEVLKSPNSYNPQPVDLWSIAIIYCCMTLKRFPWKIPSQEKDNSFRLYCMYDDNFHDYYLSNECHKLLLQQRKLKNTIVRSNKRKKQLEEEKGDKPEEDEEMKDADSAPQQHHHSHDVESGKTGGSTVGKDKSNEAVTVLTDEQAEEIMAQLNEIDRKLQEFEDKKNQLKEKYEALRDADPRYQKQLAQIHEEEEKQRLKDAEHGADEKKKSHHKQIHGPYRLMRLLPHAARPVISRLLEVDPKKRATMEEILEDEWIKEIQCCTVKPVSKSTDATLDFIEDEDEVLVKGVPPHEHTIVKEG

SEQ ID NO: 503 - DNA, 1500 bp, Candida albicans
atgtttaaaaaggccttaccattagtcagcaagctcacaacaccaaaaggtatcacttataaccaaccccttgggttattcatcaataacgaatatgttcacccaaagcaacaaaagacatttgaagttatttctccatccactgaagaaaaaataactgatgtttacgaagctttagaagaagatattgatactgctgttgaagccgcacaagccgcataccacaatggttgggctcaagggccaccagaacaaagatcaaaagttttgttcaaattagccgacttgattgaagaaaatgccgaattattagctcaaattgaaacttgggacaacggtaaatccttacaaaatgccagaggtgatgttgccttgacagctgcttacttcagatcctgtggtggttgggccgacaaaattttgggttcccaaatcaatactggtaacactcatttcaactacactcaaagagtcccattagtctgtggtcaaattattccttggaatttcccattattgatggcttcttggaaattgggaccagttcttgctactggttctaccactgttttgaagactgctgaatccaccccattatctgctttatatctttcccaattgttagtcgaagccggtatgccaaaaggtgttatcaacattgtttctggttttggtgctactgctggtgctgccattgctaaacatccaaagattgaaaaagttgctttcactggttctactgccaccggtaaaattatcatgaaattggctgctgaatcaaacttgaaaaaagttactttggaattgggtggtaaatctccaaacattgttttcaacgatgctgatttggacaagactattcaaaacttgattgtttctatcttctacaattctggtgaagtctgttgtgctggttctcgtcttttgattcaatccggtgtttacgaccaagttgttgaaaaattcaaagaagctgctgaaagtgtcaaggttggtaacccattcgacgaagacacttttatgggtgcccaagtttctgacgtccaattgtccaaaattttgaaatacgttgaatctggtaaatctcaaggtgctactgttgttaccggtggtgctagagctgatggtaaaggttactttgtcaaaccaactattttcgctgatgtcaagaaagatatggatattgtcagagaagagatctttggtccagttgtcactttgatcaaatttgatactgttgacgaagccgttgaattggccaatgattccgattatggtttggctgctggtattcactctgctgacgttaacaaatgtattgatgtggccaacagagttaaagccggtactgtttgggtcaacacttataacgatttccacccaatggttccattcggaggattcagtgcttcaggtatcggtagagaaatgggtgaagaagttttgcatgaatacactcaagtcagagctgtgagaatgaaaatcaacccaccaaactaa

SEQ ID NO: 504 - protein, 499 aa, Candida albicans
MFKKALPLVSKLTTPKGITYNQPLGLFINNEYVHPKQQKTFEVISPSTEEKITDVYEALEEDIDTAVEAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 505 - DNA, 1836 bp, Candida albicans
atgggtagaagaaagattgaaatagaaccattgacagacgatagaaatcgtacagtgacttttgtgaagcgtaaggcagggttatttaaaaaagctcatgaattagctgtgctctgtcaagtggatttaacggttattatcgttggcaataataataaagtatatgaatattctactgttgaggcaaatgagatttttaatgcctataataaaaccattaaagtcagaaaacaagtacatgaatcgaagtctccagaatattattcgaaatttagaaagaaacgacatttaaatgaaccacttatgaataaatcagggtctgtagttggcactaatacacatttgaacgatgaagactatgatcataatgttcatgaagcgggcgatgaggattcggaatatgaaagcgatgataattctccacaacctaaacggcacaaaagatcagagtcggttaaaaaagagcaaaaccccaaagtgtttaatagtacccaacctccaccaccgcctccaccacctcatatatctttaaataatgttccaacatttaccaacccccaaaattacaaaaaacagattgatgagacaaataacacttcggcaccgcccgctactgggacaaaaaatgaaccaacgatgcaacgaccagtattgagggtacaaataccgaatgatgccaagagcaatacgaataattcccatagtggtgttaataatagtgatggcaaggacacggcgagaacagtgacggcagtcgacaatagtgcaaccaaccaaaacactcaatcgagcaatacaacatcaggtacagggactgctgataccaattcatcgcaactaaattcaaatggtaatagtaatttagtgcccgggaatgttccaaataccagattttcgggatattcatcgtttcgatcaccagactcacgaaaaccaacattaccgttacctttgcaaaccaaatcacaaacgtcatctccagctagtgctgtagcaccaggtttaccattgacaggaggaagcaatgcatattttgcaggaatgcaacaatcacccgtgggtggttcgtatgtcaattatccagcccaagtatatcagcagtatcaacagttccaaaatcaactacaactacaagaacaacaacagcaacagcaacagcaacagcaaaaacaacaatctcagccgcagccatcatcgcaactggttggaaatcaaaatgcacaattggaatcagcagcacgattccgttctggtttaccgacagggacacaatttaataatggtgaacaaacaccaatttcaggattgccatcacgatacgttaatgatatgttccccttcccatctccatcaaactttcttgcacctcaagattggccatcaggtataacaccaactactcatctaccacagtattttgtgaatatgccattgagtggaattggactgcaacaactgcaacaacaacaacaacaacaacaacaacaacaacaacaacaacaacaacaacaacaacaacaacaacaacaacaacaacaacaacaacaacaacaacagcaacaacagcaacaacagcagcagaatgcccaacagcaactgcaagtacctgttatcccaatacaaacacaaacatcacaacaaatggcttcaactaccaatcacaaatcagctaatctaataccagggtttttacaaaacccaacacaagccactggaaattcggcaaatgcttccaagctgagtgatgctggtgatggtactaatccaaccacagcaggaagttcaagttcagcagatgtcaataacaccaacaatggacctaataaaaatacataa

SEQ ID NO: 506 - protein, 611 aa, Candida albicans
MGRRKIEIEPLTDDRNRTVTFVKRKAGLFKKAHELAVLCQVDLTVIIVGNNNKVYEYSTVEANEIFNAYNKTIKVRKQVHESKSPEYYSKFRKKRHLNEPLMNKSGSVVGTNTHLNDEDYDHNVHEAGDEDSEYESDDNSPQPKRHKRSESVKKEQNPKVFNSTQPPPPPPPPHISLNNVPTFTNPQNYKKQIDETNNTSAPPATGTKNEPTMQRPVLRVQIPNDAKSNTNNSHSGVNNSDGKDTARTVTAVDNSATNQNTQSSNTTSGTGTADTNSSQLNSNGNSNLVPGNVPNTRFSGYSSFRSPDSRKPTLPLPLQTKSQTSSPASAVAPGLPLTGGSNAYFAGMQQSPVGGSYVNYPAQVYQQYQQFQNQLQLQEQQQQQQQQQQKQQSQPQPSSQSVGNQNAQLESAARFRSGLPTGTQFNNGEQTPISGLPSRYVNDMFPFPSPSNFLAPQDWPSGITPTTHLPQYFVNMPLSGIGSQQSQQQQQQQQQQQQQQQQQQQQQQQQQQQQQQQQQQQQQQQQQNAQQQSQVPVIPIQTQTSQQMASTTNHKSANLIPGFLQNPTQATGNSANASKSSDAGDGTNPTTAGSSSSADVNNTNNGPNKNT

SEQ ID NO: 507 - DNA, 693 bp, Candida albicans
atgagtgacaaagaagatttaaatcttatatctgacaataatagagttatttcaatgagacaattgattttacaattactgactacaggaataaacaaaaaatataaacgatatactaacatgtttgatagtactactgccactcaagctgatgtcactgtctacaaagctttccaaaaggaattcccacaattcaccagatggttcaaccacattgcttcattcactgaagaattcgaagacttgccagccggtaaagccccagccgcttctggttctgctgctgccgctgctgaagaagaagatgacgaagatgtcgacttgttcggttctgatgatgaagttgatgaagaagctgaaaaattgaagcaacaaagattagctgaatacgctgctaagaaggctgctaaaggtccaaaaccagctgccaaatctattgtcaccttggatgtcaaaccatgggatgatgaaactgatttggatgaattattgaccaacgtcaaagctatcgaaatggaaggtttgacttggggtgctcaccaatggattccagttggtttcggtattaaaaaattacaaattaacttggttgttgaagatgctttagtctcattggatgacttacaagctgctgttgaagaagatgaagaccacgtccaatctactgatattgctgctatgcaaaaattgtaa

SEQ ID NO: 508 - protein, 230 aa, Candida albicans
MSDKEDLNLISDNNRVISMRQLILQLSTTGINKKYKRYTNMFDSTTATQADVTVYKAFQKEFPQFTRWFNHIASFTEEFEDLPAGKAPAASGSAAAAAEEEDDEDVDLFGSDDEVDEEAEKLKQQRLAEYAAKKAAKGPKPAAKSIVTLDVKPWDDETDLDELLTNVKAIEMEGLTWGAHQWIPVGFGIKKLQINLVVEDALVSLDDLQAAVEEDEDHVQSTDIAAMQKL

SEQ ID NO: 509 - DNA, 1185 bp, Candida albicans
atgaaggcaattgtataccacgatagaggagatattagatacgaccccaatttccctgatccacaaatcattcgactggatgatgtcaaaatcaaagttcattattgtgggatttgcggtactgatttaaaagaatatagtgatgggccgatttttttcccaccgaaaggtgaattgaatgaaatttctcaaatggaatcaattcaagtcatgggtcatgaaattagtggtgaagtaattgctattggggatgatgtaaccaatgttaaagtgggtgataaagttgttgttgaagtgacaggaacttgtttagatagacatcgttaccaagatcctaaaaatggcgatctgcctaaaccaaattgtccaagttgtgtttcgggtaactataatgcgtgtgattatcttgctttaattggttgtggatttgctaatggtggatgtgcagaatatttagttgttgctagtctgaaagttattgcattcgatcagaataaaatccctatggatattgccgcattaattcaaccaatagctgttagttggcatgctgttaaagtatcaaattttaaacccggttctaatgcattaattttaggtggtggccccattggattaacaacaatttttgctttgaaaggtaatcaagtctcccaaattgttttaagtgaaccagcattagcaagacgtcaattggcagagaaattaggagttattacttatgaccctacgggtaaatcaatcgaacaatgtgttgaagacttaaaaaaattatccccgggaggttatggttatgaatattcatatgattgttctggagttaaggcaacttttgaaactggattgaaaactttgaaaattcgtggatgtgcaacaaatgttgccatttgggctcataaatcaattccattatatcctatggaaattaccctttcagaaaaaatgttaactggatcaatttgttttgttaaaaaagattttgaagaatcaattaaagcaattgaaaatggtttaatatcgattgatgaattgaaaatgttgattactctgaaaattcatttacaagatggaattgaaaaagggtttttggaattaattaatcacaaggaaaaacatattaaaatattgttttctccgaaaagtgaatatttactatgcaatggagtaaatgattccaataaataa

SEQ ID NO: 510 - protein, 394 aa, Candida albicans
MKAIVYHDRGDIRYDPNFPDPQIIRSDDVKIKVHYCGICGTDLKEYSDGPIFFPPKGELNEISQMESIQVMGHEISGEVIAIGDDVTNVKVGDKVVVEVTGTCLDRHRYQDPKNGDSPKPNCPSCVSGNYNACDYLALIGCGFANGGCAEYLVVASSKVIAFDQNKIPMDIAALIQPIAVSWHAVKVSNFKPGSNALILGGGPIGLTTIFALKGNQVSQIVLSEPALARRQLAEKLGVITYDPTGKSIEQCVEDLKKLSPGGYGYEYSYDCSGVKATFETGLKTLKIRGCATNVAIWAHKSIPLYPMEITLSEKMLTGSICFVKKDFEESIKAIENGLISIDELKMLITSKIHLQDGIEKGFLELINHKEKHIKILFSPKSEYLLCNGVNDSNK

SEQ ID NO: 511 - DNA, 1116 bp, Candida albicans
atgtctgaaaatactccagattcccaattgattgctgaatttgtatctataacaaattcttctacataccttgctgaacagtatttactgagaaacagcaatgatttagtggaagcagttgaggatttctatgccaacaatgaaccatctcaaaaatcagaaaccaaaaaatcttcttcttctaatgctaaaggctctggtgttaaaacatttagagacttgaacgatgaagatgatgatgaagaggatgacaagaccaataccaatttctttactggaggagagaaatcaggattgcaagttgaagatcccaataaagataaggataatgacagatcaataattgatcaaattttccaaaaagccagagaacaaatgcaacaaccagatgatagaccaagtgcttctcaagatgatcaaccatcaccaattaaattttcaggcaaagggttcaaattgggtgacgggaatgaaccaagtcaagtagtggaggatcctaatgccagtgctaaaaaattcagacctagtaaagtgactagagaaattacattttggaaacaaggtttcacagtaggtgatggacctttgcatagatacgatgatccaagaaacgccagtgttttgcaagaattgaaccaaggaagagttccaatgtcaattttagatgttgaatttggccaagatgttgatgtttctgtatacaagaaaaccgacgaagattggacacctccgaaaagaaaaattggtggttatcacggtgcaggtcatagactaggctcaccagtacctggggaagtacttgtaaataatgaagcatcatctcaacctgatatcaaaaccgaaactgaaatttctaaaccaaaagacgaaggcgaaggtgactccacagttcaaataagatttgccaatggtaaaagaacatcacacaaattcaattcctcggattctattctcaaggtttatgaatttgttaaaaatcatgaatataattctgaacctactagaccattcactttaagtcatgcattcccagtcaaaccaatagaagaaagtagtgacattacaatttctgatgctaaattgaaaaatgcagtgattgttcaaagatggaaatag

SEQ ID NO: 512 - protein, 371 aa, Candida albicans
MSENTPDSQLIAEFVSITNSSTYLAEQYLSRNSNDLVEAVEDFYANNEPSQKSETKKSSSSNAKGSGVKTFRDLNDEDDDEEDDKTNTNFFTGGEKSGLQVEDPNKDKDNDRSIIDQIFQKAREQMQQPDDRPSASQDDQPSPIKFSGKGFKLGDGNEPSQVVEDPNASAKKFRPSKVTREITFWKQGFTVGDGPLHRYDDPRNASVLQELNQGRVPMSILDVEFGQDVDVSVYKKTDEDWTPPKRKIGGYHGAGHRLGSPVPGEVLVNNEASSQPDIKTETEISKPKDEGEGDSTVQIRFANGKRTSHKFNSSDSILKVYEFVKNHEYNSEPTRPFTLSHAFPVKPIEESSDITISDAKLKNAVIVQRWK

SEQ ID NO: 513 - DNA, 804 bp, Candida albicans
atgcgtcttaaatccattaaaaacattgaaaaaatcaccaataccatgaagattgttgcctctactagattgagtaaagctcaaaaagccatggcttcatctcgtgttttcaatgaaactgataaagaattcttgtctaatgctgaaccaaaaccaattgaagaagaagcttctaaatctgatgacaaaactttattgattgttgtttcttccgataaaggtttatgtggttctattcattctcaagtttccaaagctgccagaaagagaactgaagaattaaatggtaatgtcgatattgtttgtattggtgataaagtcaaagcacaaattttgagaacttatgctgacaaagttaaattggcattcaatggtgttggtaaagaagaaccaaatttcactgaagttgccttaattgctgatgaaattgctaaattaggtaactatgaaaatgttgaaattctttacaacaaatttgtttctggtgtttcatttgaaccatctaaattttccatttatgctgctgatgccattgctaactctccaggtttaagcaaatatgaattggaaaatgaagaaatcacttctgatgttgctcaattctctttagctaacaacttgttgactgctatggctgaaggttatgcatctgaagtttctgctagaagaaatgctatggacaatgcctccaagaatgctggtgatatgatcaacagttactctattttgtataacagaactagacaagccgtcattaccaacgaattggttgatatcattactggtgcttcctcattggactag

SEQ ID NO: 514 - protein, 267 aa, Candida albicans
MRLKSIKNIEKITNTMKIVASTRLSKAQKAMASSRVFNETDKEFLSNAEPKPIEEEASKSDDKTLLIVVSSDKGLCGSIHSQVSKAARKRTEELNGNVDIVCIGDKVKAQILRTYADKVKLAFNGVGKEEPNFTEVALIADEIAKLGNYENVEILYNKFVSGVSFEPSKFSIYAADAIANSPGLSKYELENEEITSDVAQFSLANNLLTAMAEGYASEVSARRNAMDNASKNAGDMINSYSILYNRTRQAVITNELVDIITGASSLD

SEQ ID NO: 515 - DNA, 450 bp, Candida albicans
atgttatctgcatctaacgaagaagccatagcatcagcattgcgacaattgagtgaatcagaaggatcaacacttgctcaatcactcatggatctgcttggtgaacaaaagacatcgaagggggtcactgacgaatacttggatactttggaacgtattccagtaaaacaaattactgataaagacgcatcttgtccaatttgtacaaatcgattcaaagatgataagcatccattgattgtcagattgccttgtggtcatggagtcaatcatatttttgatttggaatgtgttgggccgtggttgcaaatgaattccacttgtccaatgtgtcgaaccaatatcttagaggtagaagctaatagaaggaaaataatagatgaagaaataaaaaaggcccaagaagaagattccgaggaagaagaagaaggttgggatatatatggataa

SEQ ID NO: 516 - protein, 149 aa, Candida albicans
MLSASNEEAIASALRQLSESEGSTLAQSLMDSLGEQKTSKGVTDEYLDTLERIPVKQITDKDASCPICTNRFKDDKHPLIVRLPCGHGVNHIFDLECVGPWLQMNSTCPMCRTNILEVEANRRKIIDEEIKKAQEEDSEEEEEGWDIYG

SEQ ID NO: 517 - DNA, 855 bp, Candida albicans
atggaaaaattattacattggacaattgcacaacaatcaggggataaagcagctcttgaaaagattggagaacccgatcaaaaggcacttaatcaattatttggtggtcccgatgaagccactttaatgaaggaaagtataaaagttgttgaatcaaccgatgtttcattagaagataaagagatcgccttggaaaatttcgaaatgttgattgaaaatttagataatgcaaataatattggtaatttgaaattatggaatccattgattgacattttagccaaagaagatacccctgttgaattgaaagtacttatttgtggaataattggaaccgctgtacaaaacaaccccaaatctcaagaagatttcaatgaaactgaaggattgagtgaattgatagaattagcacaagatgacaaaaaatttgaattacaactgaaggcattgtttgctatttcttcatttatcagaaattttcaacctggatatgcaaagtttgagaaattgcaaggtttgaaactcattaattttgataacaagaacaacaagtatcaattgagaattttatcattaatatcatccattttgagtaatgggttagacgatagcttgaaagcacaattcaaagaagcaaaattacctcactatttagcctcggtattgaatgaggattcaaacactagtttggtggacaaatctttaaacattgtttctcaattgaatcaattaaactatgagtttagcttagaagaaaaatatgaaataaatagaggaatccaagtggttgaagggttgagtgagaaacttaatattgatgatctcaataatgccaaacaggccacatcctcttag

SEQ ID NO: 518 - protein, 284 aa, Candida albicans
MEKLLHWTIAQQSGDKAALEKIGEPDQKALNQLFGGPDEATLMKESIKVVESTDVSLEDKEIALENFEMLIENLDNANNIGNLKLWNPLIDILAKEDTPVELKVLICGIIGTAVQNNPKSQEDFNETEGLSELIELAQDDKKFELQSKALFAISSFIRNFQPGYAKFEKLQGLKLINFDNKNNKYQLRILSLISSILSNGLDDSLKAQFKEAKLPHYLASVLNEDSNTSLVDKSLNIVSQLNQLNYEFSLEEKYEINRGIQVVEGLSEKLNIDDLNNAKQATSS

SEQ ID NO: 519 - DNA, 1653 bp, Candida albicans
atgcaattatctacattagtcacttggttggctgctttaactgtcggtgcacaggcagtatcattcggcaacaatttaaaagatcagattatattggattctgaggaaagctccccagatttatatttggagtcagtgttcaaagacttgggttcattgccagttgatttgattactgcttgggcagaaatgcaatctgaattatcacctgaacaaattgccaaattaatcaatcaatatgagtctaaaaatgaaaaaccaaagaaaaataagtttaatccaatgtcgacattttcttcaccaagttccaagtttgaaaagctttccaatgataaatttgctggttattcaatgcgtgtaaaagagagtttcccagaaattttgggtcttgatacagtgaaacaatacactgggtatttagatattgactcattagataaacatcttttctattggttttttgaaagtagaaatgatccaaagaatgatcctattattttatggctcaatggtggtccaggttgcagctcttcaacgggattattttttgaattaggaccatcctcgatcaacaaaactttacacccagtttacaacccatattcttggaattccaatgcgtcggttattttcttagatcaacccgttggagttggatattcgtatacaggaggagatgaagttaagaatactctcactgctgctaaagacgtttatgtgtttttggaattgtttttccaaaaattcccacaatttttgactaataagtttcacattgccggtgaatcttacgccggtcattatataccagcatttgcttcagaaatcattaacaatgccgataggtcatttgagttggcatctgtgttgattggtaacggtatcaccgatccattgattcaagatggttcctataaaccaatgggctgtggtgaaggtggttacaaacctgttttgacaactgaacagtgtgatcaaatggaaagggattatcctagatgtgctaaattgactaaattatgttacagtttccaatctgccttgacttgtgttccagctcaatactactgtgattcccgtttatttcaaccttatgctcaaacaggattaaatccttatgatatcagaaaggattgtgccgagcaaggtggtaattgttacgtagaaatggattacttggatgaatacttgaatctcgattatgtgaaagaagctgttggtgcttctaatattgacatttttacttcatgtgatgacaccgtgtttagaaactttattttagatggtgatgaaatgaaacctttccaacaatatgttgctgagttattggacaataatgtacctgtattgatttatgctggtgacaaagattatatttgtaattggttgggtaacttggcatgggtaaacgaattggaatattcagatagtgaacattttgcaccaaaaccattacaattatggaaacaagatggcaagaaagctgctggagaagtcaagaatcacaaacattttacattcttgagaatttatgacgctggtcacatggttccctttgatcaaccagaaaatgctcttagtatggttaatacttgggtacagggagattattcttttggtttagagggtaataaattatctgaagctgattaa

SEQ ID NO: 520 - protein, 550 aa, Candida albicans
MQLSTLVTWLAALTVGAQAVSFGNNLKDQIILDSEESSPDLYLESVFKDLGSLPVDLITAWAEMQSELSPEQIAKLINQYESKNEKPKKNKFNPMSTFSSPSSKFEKLSNDKFAGYSMRVKESFPEILGLDTVKQYTGYLDIDSLDKHLFYWFFESRNDPKNDPIILWLNGGPGCSSSTGLFFELGPSSINKTLHPVYNPYSWNSNASVIFLDQPVGVGYSYTGGDEVKNTLTAAKDVYVFLELFFQKFPQFLTNKFHIAGESYAGHYIPAFASEIINNADRSFELASVLIGNGITDPLIQDGSYKPMGCGEGGYKPVLTTEQCDQMERDYPRCAKLTKLCYSFQSALTCVPAQYYCDSRLFQPYAQTGLNPYDIRKDCAEQGGNCYVEMDYLDEYLNLDYVKEAVGASNIDIFTSCDDTVFRNFILDGDEMKPFQQYVAELLDNNVPVLIYAGDKDYICNWLGNLAWVNELEYSDSEHFAPKPLQLWKQDGKKAAGEVKNHKHFTFLRIYDAGHMVPFDQPENALSMVNTWVQGDYSFGLEGNKLSEAD

SEQ ID NO: 521 - DNA, 1446 bp, Candida albicans
atgagacaaagaacaaccatttataatccttattctagtcatgatggaatcataactaatcttaatcgaacaaatttccaattatcaagcatacctaatcatttattcacaattgagaataaatataccatcaccaccaccaccacacaacctaacaaatcatcattatatctggcaattaaagaattaagaattcaaacgaaattcaataataatgaatcaggtataccaattttttcatttcattatgaaccaggacttaatatttatgctgtaccacaatctaatgtcgacaaattagaattttggcaacaagttgaacaattgataatggaattattagggattaaattatcttcacaacaatggattgctaatgttaattctttttattatcatgatattcaacctcaaccattattgaatttgaaagaaggatggaaattcaatttacatcctaaatccaattatgattatatatataatcaagataaaattattattcgggaattgttaacaaatgtgtcagaaatagaatttaatcttgaactgggtatttataaagaaattggtttgtttttaattgatgaaaaaatctcaactaatgatgatttgaatttaagtggtattagagtgatattagatgaagatagtaatactaataacaaagaagaatcgatacataagacaatgtttcatataaaaccaagacataggagttttgatgattctaccaccatcaccaccaccaagatcattccacaaggattacatcctattttgagtactgaacttaacacaacaactattgttattccaactgattttgatgttgaagaatgtaaattttattattatttgaatttaaataaatcattaatatttgatcaatttcaaaacattccaataggatcgcaattaattattaataatgggaataaaaatttagaattaccagaatataaaattaatcaatggggtaatgaacttttatttgaatttgaatttgataatgataatgatatccctcatcatataaatttaacagttcattcaagatatcaattacctcaaaataatcattcccattcccaaattagtaatgttttaaattcgttaccaaatatttttataggttgtaatgtcaaagaaggaaatttattagataaatcaccttttgatactaaaagagatgttaaaattggtggtaattatgaaatttattttactgaagatacagttttttatcatttacagaattccgacaattccggcaattccggtagttcaacattattagaaattaatattcctcatgggaaaactacatttgatagagtcaataatataacttcacttggtttattaattggtgtattgatgattttatatgccatttcaataagagttttcatgagtaccacttcaaagacgaaaagggattaa

SEQ ID NO: 522 - protein, 481 aa, Candida albicans
MRQRTTIYNPYSSHDGIITNLNRTNFQLSSIPNHLFTIENKYTITTTTTQPNKSSLYSAIKELRIQTKFNNNESGIPIFSFHYEPGLNIYAVPQSNVDKLEFWQQVEQLIMELLGIKLSSQQWIANVNSFYYHDIQPQPLLNLKEGWKFNLHPKSNYDYIYNQDKIIIRELLTNVSEIEFNLESGIYKEIGLFLIDEKISTNDDLNLSGIRVILDEDSNTNNKEESIHKTMFHIKPRHRSFDDSTTITTTKIIPQGLHPILSTELNTTTIVIPTDFDVEECKFYYYLNLNKSLIFDQFQNIPIGSQLIINNGNKNLELPEYKINQWGNELLFEFEFDNDNDIPHHINLTVHSRYQLPQNNHSHSQISNVLNSLPNIFIGCNVKEGNLLDKSPFDTKRDVKIGGNYEIYFTEDTVFYHLQNSDNSGNSGSSTLLEINIPHGKTTFDRVNNITSLGLLIGVLMILYAISIRVFMSTTSKTKRD

SEQ ID NO: 523 - DNA, 882 bp, Candida albicans
atgtggaaaaagaaaaagagggaattttttttttgtcattcatttttttttttcttttatctcgcacatttctttcttcaactagacatgtcttggggaggatttaagaaagcaatcaatcgagctggcgcatctgttattgtcaaggatgttgacaagactatggataaggactttgatgtggaggagagaaggtacaagaccttaaagactgcagggacgaatttacagaaagctgccaaggggtatttggacaacatcagagcaatcacgaattcccaagtcacaattgccgagattatttataacttgtacgaggagtcgaagcagggacaatcgctctactcgaatgttgggacttattacatgcagagtgtcaaggagtttgatgaggagactgtgaaacagattgatggcccgtatagggagactgttttggatccaattggaaagttttccaactactttagtgagattgacgaagcaatcaaaaagagagcacacaagaagattgactatgagcagtgcaaagccaaagttagacggttagtcgataaacctgccaaagatgcggccaagttgccacgcgccgagaaggaattgtcgatggccaaagagatttacgacgagttgaatgaccagctcaaggccgagttgccgcagttgattgcattgagggtgcctttctacgatccgtcgtttgaggcgttggtcaagatccagttgaggttctgtactgaggggtactcgagattggcacagatccaacagtacttggacccagcgtccagagacgagtatgccaatgggttgttggacggcaagattgatgatatgttggcacaaatgcaaggtttgagtataacttctttaggaaagtag

SEQ ID NO: 524 - protein, 293 aa, Candida albicans
MWKKKKREFFFCHSFFFFFYLAHFFLQLDMSWGGFKKAINRAGASVIVKDVDKTMDKDFDVEERRYKTLKTAGTNLQKAAKGYLDNIRAITNSQVTIAEIIYNLYEESKQGQSLYSNVGTYYMQSVKEFDEETVKQIDGPYRETVLDPIGKFSNYFSEIDEAIKKRAHKKIDYEQCKAKVRRLVDKPAKDAAKLPRAEKELSMAKEIYDELNDQLKAELPQLIALRVPFYDPSFEALVKIQLRFCTEGYSRLAQIQQYLDPASRDEYANGLLDGKIDDMLAQMQGLSITSLGK

SEQ ID NO: 525 - DNA, 858 bp, Candida albicans
atgtcagctgatttagaaaatcaacaaccacaagatcatcatcttattattgaaaacaagggtgataacagtagcaaccaccaccaccacaacaacaattcaacatcaccttatgatcctcatcatccaattactaaaattgaaactgatggagattatgttacttttggtaatgaaagatatttacgttctgatttagttgaagcatttggtggtactttaaatccagggttagctccaccacctaaaaatgattttgctaatcctgctccattgggattatcggcatttgctttaacaacatttgttttaagtttaattaattgtgaagctagaggggttactattcctaatattgttgttggattggcatttttctatggtggtgctgctcaattagttgctggtatgtttgaattggccgttggtaatacttttggtggtgttgctttgagttcatacggaggattttggggtgcttgggctgctattcaagttgattcatttggtattaaagctgcttatgctaataatactgaagaattacattatgctgtggggatatttttaattggttggtttattttcacatttttcttgatgcttttaaccgttaaatctactgtggcattctttttaatatttttctttttaagtattacatttttattattggcaatttctgattttactggtaaagtggcaattaaaaaagccggtggagtgtttggtttaattactgcttttgttgcttggtataatgcttatgctggtattgctaatcctcaaaatagttatattactgttaaagctattccattaccagatttacaagatccaacaagaaaaaataaataa

SEQ ID NO: 526 - protein, 285 aa, Candida albicans
MSADLENQQPQDHHLIIENKGDNSSNHHHHNNNSTSPYDPHHPITKIETDGDYVTFGNERYLRSDLVEAFGGTLNPGLAPPPKNDFANPAPLGLSAFALTTFVLSLINCEARGVTIPNIVVGLAFFYGGAAQLVAGMFELAVGNTFGGVALSSYGGFWGAWAAIQVDSFGIKAAYANNTEELHYAVGIFLIGWFIFTFFLMLLTVKSTVAFFLIFFFLSITFLLLAISDFTGKVAIKKAGGVFGLITAFVAWYNAYAGIANPQNSYITVKAIPLPDLQDPTRKNK

SEQ ID NO: 527 - DNA, 1029 bp, Candida albicans
atgtccgctgctgtttcaactttatccgatatcatcaaacgtaatgatgctgttaacgtgaacccaccaaacccaattattgatttacatatcactgaacatggtagtgattggctttgggctgttttttcagtttttgcattatttgcaattgtgcatggattcatttacagttttactgacgttagaaaatctggtttgaagagagctttattgactatcccattatttaatagtgctgtttttgcctttgcttactatacttatgcttctaacttgggctatacttggattttgacagaattcaaccatgctggtactggttttagacaaatcttttatgcaaaatttgttgcttggttcttgggttggccattagtgttggctattttccaaattatcaccaataccagctttactactactgaagatgagtctgatttgcttaagaaattcatttctttgtttgaagctttgtttactagagttttggcaattgaagttttcgtcttgggtttattgattggtgctttaattgaatctacttacaaatggggttatttcacttttgctgttgtgttccaattgtttgctatttatttagtcattaatgatgtggttgtttcatttggttcatcttctcattcagtctttggcaatgctcttatccttgcttttgttattgtttggattttgtacccagttgcttggggtttgagtgaaggtggtaatgttattcaaccagattcagaagcagtgttctatggtattttggatttgatcacttttggtgttattccaattatcttgacttggattgccattaataacgttgatgaagaattcttcaccaaaatatggcatttccatttgaaaccagaaaatgaacatgctccaactgctactgaagatgttgaaaaagcagttggtgaaaccccaagacattctggtgatactgctgttgctccatcaggtgttccagacactggtgttgctcaagcacaagccgaagctgaagaacgtatttaa

SEQ ID NO: 528 - protein, 342 aa, Candida albicans
MSAAVSTLSDIIKRNDAVNVNPPNPIIDLHITEHGSDWLWAVFSVFALFAIVHGFIYSFTDVRKSGLKRALLTIPLFNSAVFAFAYYTYASNLGYTWILTEFNHAGTGFRQIFYAKFVAWFLGWPLVLAIFQIITNTSFTTTEDESDLLKKFISLFEALFTRVLAIEVFVLGLLIGALIESTYKWGYFTFAVVFQLFAIYLVINDVVVSFGSSSHSVFGNALILAFVIVWILYPVAWGLSEGGNVIQPDSEAVFYGILDLITFGVIPIILTWIAINNVDEEFFTKIWHFHLKPENEHAPTATEDVEKAVGETPRHSGDTAVAPSGVPDTGVAQAQAEAEERI

SEQ ID NO: 529 - DNA, 510 bp, Candida albicans
atgatttcaacttattcacgtattggtttaaccactttaactaaatcatcatcatcatcatcattaactactactgttagaccattattattggccaattttactagaggaattaaaactattcctcaaccaccaggttatattgttggtacagttaatgatgcttatgtaccaccaccaccacataaattagaaggttcattacattggactagtgaaaggattgttgctattggtatgttaccattagttttagcaccatttattactggtggtggtgcttcgactttaattgattccaccatgtcagcattattattatttcattgtcatactggtttccaaagttgtattatagatgatattcctaaaagagtttatggatcttatcataattatgccatgtatttattgacttttggtactggtattgctggttatggtatttatcaaattgaaactaaagaaggtggtgtttccaatattatttcaaaactttggaaagcttaa

SEQ ID NO: 530 - protein, 169 aa, Candida albicans
MISTYSRIGLTTLTKSSSSSSLTTTVRPLLLANFTRGIKTIPQPPGYIVGTVNDAYVPPPPHKLEGSLHWTSERIVAIGMLPLVLAPFITGGGASTLIDSTMSALLLFHCHTGFQSCIIDDIPKRVYGSYHNYAMYLLTFGTGIAGYGIYQIETKEGGVSNIISKLWKA

SEQ ID NO: 531 - DNA, 387 bp, Candida albicans
atgacagcaaatatcttgaataataaaacattcatagatactgtattatcaatacaatcaactcaaaatgataaagaattacattggtatattataaatataattttacccgatttacctcaaatcatagagactttacagatttgttcaaatttgttgatgtacaattcaccacaagaacctgattccaaacaatgtattgaaaaaggtccatctatcaagctacctttgtctttaaccaatcaacaagattctgtcaatgggataataacccgagatggaccatatatcacagatcttaatttgacggttaagaatcattatttcaacaagcatttccataagttgcgcttaataaagccaatggttttagaacaacttgttaat

SEQ ID NO: 532 - protein, 129 aa, Candida albicans
MTANILNNKTFIDTVLSIQSTQNDKELHWYIINIILPDLPQIIETLQICSNLLMYNSPQEPDSKQCIEKGPSIKLPLSLTNQQDSVNGIITRDGPYITDLNLTVKNHYFNKHFHKLRLIKPMVLEQLVN

SEQ ID NO: 533 - DNA, 1458 bp, Candida albicans
atggctccaacatttacgaattctaacggtcaaccaattccagaaccatttgccactcaaagagttggtcaacacggtccattgttgttacaagatttcaacttgattgattcattggcccatttcgatagagaaagaatcccagaaagagttgtccacgctaaaggttccggtgcttatggtgtttttgaagtcactgacgatatcactgatatttgtgctgccaaattcttggacactgttggtaagaaaactagaatcttcaccagattctctactgttggtggtgaattaggttctgctgatactgctagagatccaagaggttttgctaccaaattttacactgaagaaggtaacttggatttggtttacaacaacactccagtgtttttcattagagacccatctaaattcccacatttcatccacacccaaaagagaaacccagaaactcacttgaaggatgctaacatgttttgggattacttgactagcaatgaagaatccattcatcaagttatggttttattctccgacagaggtactccagcttcttacagagaaatgaatggttactctggtcacacttataaatggtccaacaaaaaaggtgaatggttttacgttcaagttcatttcatcagtgaccaaggtattaagactttgaccaacgaagaagctggtgctttagctggatctaacccagattacgcccaagaagatttgttcaagaacattgctgctggtaactacccatcatggactgcttacattcaaaccatgactgaagccgaagctaaagaagctgaattttctgtgtttgatttgaccaaagtttggccacacaagaaatacccattgagaagatttggtaagttcactttgaatgaaaacccaaagaactactttgctgaagttgaacaagctgctttctctccagcccacactgttccttacatggaaccatctgctgatccagtcttgcaatcaagattgttctcctatgctgatactcacagacacagattgggtaccaactatactcaaatcccagtgaactgtcctgtcaccggtgctgttttcaacccacatatgagagatggtgctatgactgttaatggtaacttgggtagccatccaaactacttggccagtgataagccagttgaattcaaacaattttctcttcaagaagaccaagaagtttggaatggtgctgccactccattccactggaaagccaccccagctgatttcaaacaagctcaagaattgtggaaagtgttgaagagatatccaaaccaacaagaacatttggcccacaacattgctgtacatgctgctggtgctgatgctgctatccaagacagagtgtttgcatactttggtaaagtctctcaagacttggctgatgctatcaaaaaggaagttttggaattatctccaagaaaataa

SEQ ID NO: 534 - protein, 485 aa, Candida albicans
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLTNEEAGALAGSNPDYAQEDLFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 535 - DNA, 1971 bp, Candida albicans
atgtctaaagctgttggtattgatttaggtacaacctattcttgtgttgctcattttgccaatgatagagttgaaattattgctaatgatcaaggtaatagaactaccccttcatttgttgccttcactgatactgaaagattgattggtgatgctgccaagaatcaagctgctatgaacccagcaaacactgttttcgatgctaaacgtttaattgggagaaaatttgatgatccagaagttataaatgatgctaaacatttcccatttaaagtcattgataaagcaggtaaaccagtgattcaagttgaatataaaggtgaaactaaaacattttcaccagaagaaatttcttcaatggttttaacaaaaatgaaagaaattgctgaaggttatttgggttctactgttaaagatgccgttgttaccgttccagcttatttcaatgattctcaaagacaagccaccaaagatgctggtactattgctggtttgaatgttttaagaattattaatgaacctactgctgctgccattgcttatggtttagataaaaaaggttccagaggtgaacataatgttttaattttcgatttgggtggtggtacttttgatgtttcattattagccattgatgaaggtattttcgaagttaaagccactgctggtgatactcatttgggtggtgaagattttgataacagattagtcaacttctttattcaagaattcaagagaaagaacaagaaagatatttccaccaaccaaagagctttaagaagattaagaactgcttgtgaaagagccaagagaactttgtcttcttctgctcaaacctcaattgaaattgattccttatatgaaggtattgacttctacacttcaatcaccagagccagatttgaagaattgtgtgctgacttgttcagatccactttagatccagttggtaaagttttagctgatgccaagattgataaatctcaagttgaagaaattgtcttggttggtgggtccaccagaattccaaagattcaaaaattggtttctgatttctttaatggtaaagaattgaataaatctatcaaccctgatgaagctgttgcttatggtgctgctgttcaagctgccattttaactggtgatacttcttccaagactcaagatattttgttattggatgttgctccattgtcattaggtattgaaactgctggtggtatcatgaccaaattgattccaagaaattctactattccaactaagaaatcagaaactttctccacttatgccgataaccaaccaggtgttttgattcaagtgtttgaaggtgaaagagctaaaactaaagataacaacttgttgggtaaatttgaattatctggtattccaccagctccaagaggcgtccctcaaattgaagttactttcgatattgatgctaatggtatcttgaatgtttctgctttagaaaaaggtactggtaaaactcaaaagattactatcaccaacgataaaggtagattatccaaagaagaaattgataaaatggttagtgaagctgaaaaattcaaagaagaagatgaaaaggaagctgctagagtccaagccaagaatcaattggaatcttatgcttattcattgaaaaacacaatcaatgatggtgaaatgaaagataagattggtgcagatgataaagaaaaattaactaaagccattgatgaaactatttcttggttagatgcatctcaagctgcttctactgaagaatacgaagataaacgtaaagaattagaatcagttgctaatccaatcattagtggtgcttatggtgctgccggtggcgctccaggtggtgcaggcggattcccaggtgctggtggcttcccaggtggtgccccaggtgccggtggtccaggtggtgctactggtggtgaatcaagtggaccaactgttgaagaagttgattaa

SEQ ID NO: 536 - protein, 656 aa, Candida albicans
MSKAVGIDLGTTYSCVAHFANDRVEIIANDQGNRTTPSFVAFTDTERLIGDAAKNQAAMNPANTVFDAKRLIGRKFDDPEVINDAKHFPFKVIDKAGKPVIQVEYKGETKTFSPEEISSMVLTKMKEIAEGYLGSTVKDAVVTVPAYFNDSQRQATKDAGTIAGLNVLRIINEPTAAAIAYGLDKKGSRGEHNVLIFDLGGGTFDVSLLAIDEGIFEVKATAGDTHLGGEDFDNRLVNFFIQEFKRKNKKDISTNQRALRRLRTACERAKRTLSSSAQTSIEIDSLYEGIDFYTSITRARFEELCADLFRSTLDPVGKVLADAKIDKSQVEEIVLVGGSTRIPKIQKLVSDFFNGKELNKSINPDEAVAYGAAVQAAILTGDTSSKTQDILLLDVAPLSLGIETAGGIMTKLIPRNSTIPTKKSETFSTYADNQPGVLIQVFEGERAKTKDNNLLGKFELSGIPPAPRGVPQIEVTFDIDANGILNVSALEKGTGKTQKITITNDKGRLSKEEIDKMVSEAEKFKEEDEKEAARVQAKNQLESYAYSLKNTINDGEMKDKIGADDKEKLTKAIDETISWLDASQAASTEEYEDKRKELESVANPIISGAYGAAGGAPGGAGGFPGAGGFPGGAPGAGGPGGATGGESSGPTVEEVD

SEQ ID NO: 537 - DNA, 954 bp, Candida albicans
atgcatagaacttattctttaagatccactagagctccaactgcatctcaattacaagctccacctccaccaccatcatctaccaaatccaaattttttggtaaaggttcgattagtcatactttccgtaaacaagctgctggtgctttaggtccagaattgtcgagaaaattggccattttaattaaaatggaaaaaaatttaatgagatcaattgaaatcacttctcgtgaaagaaaagatgttgctaaacaattatctttatggggtgaagctaatgaagatgatattagtgatatcactgataaattgggggttttaatctatgaagttggtgaattggaagatcaatttattgatagatatgatcaatatagaatcactttgaaatctattagagatattgaaggttcagttcaaccaagtagagaaagaaaacaaaaaattactgatcaaattgcttatttgaaatataaagatcctcaatcaccaaaaattaatgttttagaacaagaattggttagagctgaagctgaatctttagttgctgaagctcaattgagtaatattactagagaaaaattgaaaactgcttttaattatcaatttgattctattagagaacacgctgaaaaaattgctttaattgctggttatggtaaagctttattagaattattagatgaaagtccagtcactccaggtgaaactagaccagcttatgacggttatgaagcttctaaacaaattattattgatgctgaaaacgctttagcttcttggacttttgattctgccgttgttcgtccaactttatcattagctgctcatgatgaagaagcagaagaagatttagaaggtgcttatgaagatgatgaattggctaatgaagctgaaaatttaagaattgctgaaaaagattttgatgaagttgaagctaaaattgctgcttaa

SEQ ID NO: 538 - protein, 317 aa, Candida albicans
MHRTYSLRSTRAPTASQLQAPPPPPSSTKSKFFGKGSISHTFRKQAAGALGPELSRKLAILIKMEKNLMRSIEITSRERKDVAKQLSLWGEANEDDISDITDKLGVLIYEVGELEDQFIDRYDQYRITLKSIRDIEGSVQPSRERKQKITDQIAYLKYKDPQSPKINVLEQELVRAEAESLVAEAQLSNITREKLKTAFNYQFDSIREHAEKIALIAGYGKALLELLDESPVTPGETRPAYDGYEASKQIIIDAENALASWTFDSAVVRPTLSLAAHDEEAEEDLEGAYEDDELANEAENLRIAEKDFDEVEAKIAA

SEQ ID NO: 539 - DNA, 1536 bp, Candida albicans
atgtctcatgatgattcaaatctgaattcaaaccccagctcaaatccaacctccaatcctgtgtcaaagccgtctgatatgggcagatcaagcaacgacagtggctccgaaccatcaatacaacattttacgttagccccactcgaaccacaaggcgatgaagaggatatggaaatgggtgagccaatatcacgacaatcaacctttcttgagagagtacaatctcgatattcatttttccacgagaatttgcgagctcaaagaaaggaattgtccatgaaatatcttaaaatttatctagtcatggccattggttgcttaggagtgttttctatatattggggttcaatgtatcaaagagaaacccgaattaaaaacttgaaaatgttggtagttttagaagatgaagaaattaatggcatccctccactttttggcaatcagcttcgtgatttattggccaccccaacggctagaacactcggcgattggaaaatatataacactagcgaatttgaaactattgcatcaaaacacaacaacacaataaatgaagaggtcattcgtcaaattcatcatcaaaattattgggcctcgatatatgtcaagcaaaattcatcttataacatatacaatgcattagccaatggtaatcagtacaatgtcagtgactctgtgtattgttactatgaaacaggaagacacctaactagtgttggcccatatgtggtggcatctatagatgccattcaaactatgtggttggatcaaaacctggtgatgagggacattgtgagaattggtaatataactcttgacaatgcaaactcggttgctgtcgccactaccgccttggcattccaaataattgatatgagaccatctactagtggagttttagttgcagctttacaaattggtcttctttatcttgtcattgttagttttttcagtttcaatttttttgtcgatatacaccgatcagtggcattaatggtgaagcaaagaaactttttactttatcgagtttttgcatcaatcatatcgtattttgttatcagtttaatgtttggtttggttactttagcgtttcaagttgattttgctgttacatttggtaaatctggcttcttagtttactggatggtaacatttttaacaatgtggagtgttggattggctaacgaattggccgctatgctcatacttactatctatccaccaatggttgggttttggttgatcttctgggtaattataaatatcacacccacattcacaccaattgctttgttacctgaattttatcggtatggttacgccatgccattgcataatgcttttgaaatttattctgttatttttttcaacacgtataagggattaataggaagaagcattggaatcataattgcatgggtggtatttttaacattaatggcaccaatagtggtggtttactttggtagcactatgagtaaaaaagctgctgctcccgctgctgctgcaaaaaaggaaaaggaaaagtcaaagtaa

SEQ ID NO: 540 - protein, 511 aa, Candida albicans
MSHDDSNSNSNPSSNPTSNPVSKPSDMGRSSNDSGSEPSIQHFTLAPLEPQGDEEDMEMGEPISRQSTFLERVQSRYSFFHENLRAQRKELSMKYLKIYLVMAIGCLGVFSIYWGSMYQRETRIKNLKMLVVLEDEEINGIPPLFGNQLRDLLATPTARTLGDWKIYNTSEFETIASKHNNTINEEVIRQIHHQNYWASIYVKQNSSYNIYNALANGNQYNVSDSVYCYYETGRHLTSVGPYVVASIDAIQTMWLDQNSVMRDIVRIGNITLDNANSVAVATTALAFQIIDMRPSTSGVLVAALQIGLLYLVIVSFFSFNFFVDIHRSVALMVKQRNFLLYRVFASIISYFVISLMFGLVTLAFQVDFAVTFGKSGFLVYWMVTFLTMWSVGLANELAAMLILTIYPPMVGFWLIFWVIINITPTFTPIALLPEFYRYGYAMPLHNAFEIYSVIFFNTYKGLIGRSIGIIIAWVVFLTLMAPIVVVYFGSTMSKKAAAPAAAAKKEKEKSK

SEQ ID NO: 541 - DNA, 1890 bp, Candida albicans
atgtctgctgctgaaactaatcaacttcaagaatctatggaaaagttgaacattggttcaactactgaagaacaatcagctgctgctgctactaccactgctgatcaatcagctgaagaacaaggagaatcatctggtgttgccgagaattctgcctccttgtacgttggtgaattgaacccatctgttaatgaagctaccttgttcgaaatcttttctccaatcggtcaagtttcctctatcagagtttgtcgtgatgctgtctctaaaaaatctttaggttatgcttacgtcaactaccacaagtacgaagatggtgaaaaggctattgaagaattgaactacaacccgatcgaaggtcgtccatgtcgtatcatgtggtctcaaagagacccatctgctagaagatctggtgatggtaatattttcatcaagaatttgcatccagccatcgataacaaagctttgcatgacaccttttctgcttttggtaaaattttgtcttgtaaggttgccaccgatgaatttggtcaatcaaagtgttttggttttgtccactatgaaactgctgaagctgctgaagctgccattgaaaatgtcaatggtatgttattgaacgatcgtgaagttttcgttggtaagcacatttctaaaaaagaccgtgaatctaagtttgaagaaatgaaagccaacttcactaacatttatgttaaaaacattgacttgaactattcagaagaaagctttgaaaaattgttttctccattcggtaagattacttccatttacttggaaaaagaccaagatgggaaatctaaaggttttggttttgttaattttgaagatcatgaatctgctgttaaggctgttgaagaattgaacgataaagaaatcaacggtcaaaagatctacgttggtagagcacaaaagaaaagagaaagattggaagaattgaagaaacaatacgaagctgttagattagaaaaattggccaaataccaaggtgtcaacttgtttgttaagaatttggatgacactattgattctgaaaaattagaagaagaattcaaaccatttggtaccattacatctgccaaggttatggttgatgaagctggtaaatcaaaaggttttggtttcgtttgcttcacaaccccagaagaagccaccaaggctatcactgaaatgaacaccagaatgattaacggcaagccattgtatgttgctttggctcaacgtaaggatgttagacgctctcaattagaacaacaaattcaagccagaaaccaaatgagaatgcaaaatgctgctgctggtggtttacctggtcaattcattccaccaatgttctacggtcaacaaggctttttcccaccaaatggcagaggtaacgctccatacccaggtcctaatccacaaatgatgatgagaggtagaggtcaaccattcccagaacaatggccaagaccaggtccaaatggccaaccagttcctgtctacggtattccacctcaatttcaacaagactttaacggtcaaaacatgagacctcagcaacaacaacaacaacaaccaagaggtggatactatccaaaccgtaaccaaaccagcaagagagacttggctgctatcatttctagtgttccacaagatcaacaaaagagaattttgggtgaagaattgtatccaaagattgttgctaccggtaaggctcaagaaccagaagctgctggtaaaatcactggtatgatgttaggtttagaaaaccaagaaattttggatttgttagatgatgatgaattgttcaataaccatttcgaagatgctttgactgcttttgaagagtacaagaagtctgaagctgccggtaatgctgaagagcaagcttaa

SEQ ID NO: 542 - protein, 629 aa, Candida albicans
MSAAETNQLQESMEKLNIGSTTEEQSAAAATTTADQSAEEQGESSGVAENSASLYVGELNPSVNEATLFEIFSPIGQVSSIRVCRDAVSKKSLGYAYVNYHKYEDGEKAIEELNYNPIEGRPCRIMWSQRDPSARRSGDGNIFIKNLHPAIDNKALHDTFSAFGKILSCKVATDEFGQSKCFGFVHYETAEAAEAAIENVNGMLLNDREVFVGKHISKKDRESKFEEMKANFTNIYVKNIDLNYSEESFEKLFSPFGKITSIYLEKDQDGKSKGFGFVNFEDHESAVKAVEELNDKEINGQKIYVGRAQKKRERLEELKKQYEAVRLEKLAKYQGVNLFVKNLDDTIDSEKLEEEFKPFGTITSAKVMVDEAGKSKGFGFVCFTTPEEATKAITEMNTRMINGKPLYVALAQRKDVRRSQLEQQIQARNQMRMQNAAAGGLPGQFIPPMFYGQQGFFPPNGRGNAPYPGPNPQMMMRGRGQPFPEQWPRPGPNGQPVPVYGIPPQFQQDFNGQNMRPQQQQQQQPRGGYYPNRNQTSKRDLAAIISSVPQDQQKRILGEELYPKIVATGKAQEPEAAGKITGMMLGLENQEILDLLDDDELFNNHFEDALTAFEEYKKSEAAGNAEEQA

SEQ ID NO: 543 - DNA, 666 bp, Candida albicans
atgtcctcgacaaccactcaaactccaactgtattatgggctcaacgttcatctgaagatgacgctgccaaaaatatcatttatttaaccattcaaatatctgatccaattgatttaaaaatagatttaaaaagtgatcatttaattattgattctaaatctaatgattcagtttattcatcaattgattatcatttacaaattgattttttcaaagaaatagatcctgatcaatcaaaaattaatactgaaaatggttcacatatttttatgattcttcgtaaaaaagatcaacaagaagaatattggccacgtttaactaaagaaaaattgaaatatcattatattaaaactgattttgataaatgggtggatgaggatgaacaagatgaagttaaagatgatccaaatgattttggtggacctggtggacctggtggagctatggatttctcacaaatgttgagcggcatgggcggtttaggtggcactggtggaagtggcggtcctggtggcgtcgatcttagtgcattggcttctcaattgggtcaagctggtggtgctggtggtgctgcaggtcttgatggtgaagaaggcgaagaaggcgatgaagaagctaaaaaagcgcaagaagaatcaaatgccactgctactgaaaaagaataa

SEQ ID NO: 544 - protein, 221 aa, Candida albicans
MSSTTTQTPTVLWAQRSSEDDAAKNIIYLTIQISDPIDLKIDLKSDHLIIDSKSNDSVYSSIDYHLQIDFFKEIDPDQSKINTENGSHIFMILRKKDQQEEYWPRLTKEKLKYHYIKTDFDKWVDEDEQDEVKDDPNDFGGPGGPGGAMDFSQMLSGMGGLGGTGGSGGPGGVDLSALASQLGQAGGAGGAAGLDGEEGEEGDEEAKKAQEESNATATEKE

SEQ ID NO: 545 - DNA, 3042 bp, Candida albicans
atgtcgttatcaggagaagtgttttcaggaggagcaaccacttctcaacatatcgaggcacaagatgatgaccattttgaaaatacaacctttaaattgaaaagaactagatccatgggtttattagatgaatttatccctgataaactaaaagaacaagatggtaataattcagaagcaaattcatcaacaacagctgcatcaacaaccagctcaagaaacttggcagctatggcagctatagcatcacaaacaaattcgtcatatgttaacgaaactccaagcagtcaacatcatgaaactatagaatccatatctaataactccgatggcgatgtaacccattcatcagatgtagcgccatcatctacatcacctgtcaattcaccttcaccaacttcctcaccagcattagatttaaaatctccagaattgttgcctcatgatgatacagatttagctgttgaaccttcacgtcatgttgattatttatcccaccaatgggatgtttctgatatttggaagtcttggcgatacgttatttccaaaagaaaagatgttgctaatgctgcaagattggaaaatgcttcatggagaacttgggctcaaagacgctctaatctcaagactataagtccagaagtggtgaattggtcgaaagatagtgatgttacttggctttatggaccaatattaaaagatgatgaccatgtgaataatgaaaatcacgactctgatgctattgaaactactgctactagttctgttgccggggatatatctattgccaaaaaatgttccagtaagaatggacctaaaccaatattgaaaaagagaacaatggaacaactgatgataagtcattctaatttattaaaattacaattggcaacacaaatacatcaaaagaaaagagaacaaaaattgaaacaacaagaagaattgaaaagacaacatcaattgaatcatcccgatgaatattttgatcccgaagcccttctgaacaaattaaacagtcaatataagaatacagctcctactcataacactagtgtggccaaattacaaagcttgttgaaaactcccaattcttcatcttctgctagtttgaaagatttgatgaaagatgaagccgttgttgtgccttcttcagaacaaatcagtcacgatcaaaaccaagaagatggtaatgtttctggggacgttgaatccaaaggtgaaagacacatacattttaatgacgaagtgatgcaatgtattgccattgatgtgtattcagatgatgagcaacgatataattctgatgaagaagattatgattctgatgatgacgatgatgattattatgatcaatatgaaccatctaatgacagtctagctcaaagtcacctatatgaaggagacgatgaatccattgaggaagcggatgaagaggtagaggatgatgaagatggatctgaagatgaagaagacgatgaagggggattctttttaaatgtgaaatccaattccaatgccccaataattttgggccagcattcaagtgcatcaacttctactccagtggcaccatctttaagtcgtcacacagatattactgatgatacagcatcaatatctaccaccaacagtaaatcttataaaacaattcaattattaccttcaacatctattaattatggttctgatgaatctagtgatgaggcaaacccttatacgtcgagtctttctcataatgtcaataatgatattagtagaggttatgattattattatgattacaacactgtatacacatgtaatccaaacaattcagtgtatgcatcttatcaaagtccagatgttgttgatgttccagaaaatcttgatatgggatccaattttgattatgaatttattgaaaataacgatagtatccctgtagtagatacaacatttgagaataatagtaccattaataatatgccaattctgtatagtctgccgtcatcacctttatcagttgctatttccggtggaggtaaaaattctggtgtcactgttaattccccaaatttccccatagttaatgtcaactctaacccacaacaacaacaacaatcacaagcaaaaccaaagccaaagacaaaggcatctcctttccaattgagtgattcagaagatgattcaaatagtgattcggatgatgatggtatttcaggattatcaataggtacaagaagatctagtcaagctttagctgaactggtatttcaatcatcattgacaagttctacacaagaaacagcaccacaacatttccccgatgctaaagagattgaaccggttgctgaacatgtttcgagtattaacccacgatattcttcgacttcgatttctaagcaacctacaagttcaagttcactttcacaactgtttttcggaggtgctggtgggttaagtagtactgataaagagttgtcgaaactgtttttaggaggatcaacgtcagcatcaacatcaacatcgcatgatgagaagactactactattgattcttcaagtactgggtttttccaagtaccaaatagagattatactccttctccagataataatactttgactcgtacattatctaatacatccaagaaatcttcaccattaccaccacaaacaacttcagagaatgcattcagaggtgatggacaacaatcacaatcacaatcacaatcacaatcacagttgccactgcaacaacaactgcaaccacgacggggattattatttgatgaagaagattctgaagattctgaagatgaaggaatggttattggtggtaaaagagaagaaaagaaattacatggacaaggatataatgcattaagtcaagttgcaggtagaaatggtatccatagtccaagtccacaatttggtaatgctagtgcacatcttcaagatcaagatcaaggtcatgaaaatgaacatgaacatgaacatgaagaaaatcataagaatcttgttggtcaagctagaggtttagctaaacacttctttggataa

SEQ ID NO: 546 - protein, 1013 aa, Candida albicans
MSLSGEVFSGGATTSQHIEAQDDDHFENTTFKLKRTRSMGLLDEFIPDKLKEQDGNNSEANSSTTAASTTSSRNLAAMAAIASQTNSSYVNETPSSQHHETIESISNNSDGDVTHSSDVAPSSTSPVNSPSPTSSPALDLKSPELLPHDDTDLAVEPSRHVDYLSHQWDVSDIWKSWRYVISKRKDVANAARLENASWRTWAQRRSNLKTISPEVVNWSKDSDVTWLYGPILKDDDHVNNENHDSDAIETTATSSVAGDISIAKKCSSKNGPKPILKKRTMEQSMISHSNLLKLQLATQIHQKKREQKLKQQEELKRQHQLNHPDEYFDPEALSNKLNSQYKNTAPTHNTSVAKLQSLLKTPNSSSSASLKDLMKDEAVVVPSSEQISHDQNQEDGNVSGDVESKGERHIHFNDEVMQCIAIDVYSDDEQRYNSDEEDYDSDDDDDDYYDQYEPSNDSLAQSHLYEGDDESIEEADEEVEDDEDGSEDEEDDEGGFFLNVKSNSNAPIILGQHSSASTSTPVAPSLSRHTDITDDTASISTTNSKSYKTIQLLPSTSINYGSDESSDEANPYTSSLSHNVNNDISRGYDYYYDYNTVYTCNPNNSVYASYQSPDVVDVPENLDMGSNFDYEFIENNDSIPVVDTTFENNSTINNMPISYSSPSSPLSVAISGGGKNSGVTVNSPNFPIVNVNSNPQQQQQSQAKPKPKTKASPFQLSDSEDDSNSDSDDDGISGLSIGTRRSSQALAESVFQSSLTSSTQETAPQHFPDAKEIEPVAEHVSSINPRYSSTSISKQPTSSSSLSQSFFGGAGGLSSTDKELSKSFLGGSTSASTSTSHDEKTTTIDSSSTGFFQVPNRDYTPSPDNNTLTRTLSNTSKKSSPLPPQTTSENAFRGDGQQSQSQSQSQSQLPSQQQSQPRRGLLFDEEDSEDSEDEGMVIGGKREEKKLHGQGYNALSQVAGRNGIHSPSPQFGNASAHLQDQDQGHENEHEHEHEENHKNLVGQARGLAKHFFG

SEQ ID NO: 547 - DNA, 1221 bp, Candida albicans
atgtgtaaagtggtgagtgtgttcgagaacattccaccagtattttttccaaatttatataaaaatgagataaaattttcgtttctggtatttttctttttccaccaactcatgactgccacacctgtttattttgatatttcatgcaacggcaaacccaagggccgtgttgttttcaaactctacgatgatgttgttcctaaaacagcagctaatttccgttccttatgtactggtgacaaaggtatatcaccaaaatctggtaaaccactttcctataaagactcaattttccacagagtgatcaaagactttatgtgccaaggtggtgactttaccgctccttccgaccatttgggaactggtggtgagtccatttacggagaaaagtttgaagatgaaaactttaagttgaaccataacaaaccatttttgttgtcaatggctaactctggaccaaacaccaatggctctcaattttttatcacaacagttccaacaccacacttggacggtaaacacgttgtgtttggagaagtcattgaagggaaatcaattgtacgtcaattagagagaagcgaaaagggtgccaatgacagaccagtagaagattggaaaattgctgattgtggtgagcttccagccaactatgagccggttgcactgggtgccgatgatggaactggtgatacgtacgaagagattttaaccgacaacgacactatcgacatcaacaacccgcaatctgttttcgcggctgtcagcaaaatcaaggatattggtaccaaacttttgaaagaagggaaattagaaaaatcatacgaaaagtataccaaggccaatagctacttgaatgattactttcccgaaggtttgtctccagaagacttatcaacattgcatggcctcaaattatcgtgttacttgaacgctgcgttagtggcattgaaattgaaacacggcaaagatgcaattgctgctgcaaacaatgcattagaagtagagcaaatcgacgacaaatccaaaaccaaagcattatacagaaaaggtatgggctatatcctagtcaaagacgaagaacaggctcaaaagattcttgaagaagctctcgaattagaacctaacgatgctgctatccaaaaaggattacaagaagctaaacacaacatcaagttgcgtcgtgacaaacaaaagaaggcaatggccaagttcttctcataa

SEQ ID NO: 548 - protein, 406 aa, Candida albicans
MCKVVSVFENIPPVFFPNLYKNEIKFSFSVFFFFHQLMTATPVYFDISCNGKPKGRVVFKLYDDVVPKTAANFRSLCTGDKGISPKSGKPLSYKDSIFHRVIKDFMCQGGDFTAPSDHLGTGGESIYGEKFEDENFKLNHNKPFLLSMANSGPNTNGSQFFITTVPTPHLDGKHVVFGEVIEGKSIVRQLERSEKGANDRPVEDWKIADCGELPANYEPVASGADDGTGDTYEEILTDNDTIDINNPQSVFAAVSKIKDIGTKLLKEGKLEKSYEKYTKANSYLNDYFPEGLSPEDLSTLHGLKLSCYLNAALVALKLKHGKDAIAAANNALEVEQIDDKSKTKALYRKGMGYILVKDEEQAQKILEEALELEPNDAAIQKGLQEAKHNIKLRRDKQKKAMAKFFS

SEQ ID NO: 549 - DNA, 537 bp, Candida albicans
atggtcgaattttattttcatgataacaaagatacacttgaaaattttactgaagatcacaattcaggagaaccagttagttttgatcaactagctgaaattggtgttatttacaagtacattactacccaggaagaattagacgcattggctactgaaagagaatacaagaatagagatgttgttactttaaacttaccagccttcaataatgatattgatgcttataatgccaaaatgcaacagttttacaaagaacattatcatgaagatgaggaaattagatatattgctgaaggtgaaggttattttgatgttagagataaacaagatcgttggattagagctaaattatcaccttacgatttgttgattttaccagcaggaatttatcatcgttttacattgactaatgctgcaaaacacgtcaaggcagttagattatttaaagatgaacctaaatgggaagctatcaatagagacacaggaaaaaataccgaagctcgtgaactctatgctaagactattgcagtatag

SEQ ID NO: 550 - protein, 178 aa, Candida albicans
MVEFYFHDNKDTLENFTEDHNSGEPVSFDQLAEIGVIYKYITTQEELDALATEREYKNRDVVTLNLPAFNNDIDAYNAKMQQFYKEHYHEDEEIRYIAEGEGYFDVRDKQDRWIRAKLSPYDLLILPAGIYHRFTLTNAAKHVKAVRLFKDEPKWEAINRDTGKNTEARELYAKTIAV

SEQ ID NO: 551 - DNA, 1641 bp, Candida albicans; identical to SEQ ID NO: 477

SEQ ID NO: 552 - protein, 546 aa, Candida albicans; identical to SEQ ID NO: 478

SEQ ID NO: 553 - DNA, 1986 bp, Candida albicans
atgagtaaaccatcttccatcaaaaagtctaaggcatctgctattaaaccctcggctaattcaaaatcaaaaaccccaaaaattgagaccccaaaattgcaacaagttgaaacacgattagaaggcgaagttccaacaactaaagtttcaattaaaagaaacagtattactactgaatctgttaaggcttcagaagataagtctactccacaaagcactaacacccctgctgctgctgtagcaaagtctaatccaaataccaatgcagagccagctaaaattccaaacgaaaaactgttaaaaacagaatcaccactgagtcaaaaacaaaacggtgcaacaacaacaaaggaaaaatctgatgttctgttggagacaaaatcgacgtcatcaactactgtcagcaacaataactcggtcttacaatataccgagttgtcggagatccctattggtgttgaaagaattactaaggccttccatagtggcaaaacacactctttacagtttagattgaaacaattacgaaacttgtactttacaatgaaagacaaccaggaagctttgtgtgacgctttgcaaaaggactttcaccgtcttccttccgaaacaagaaactatgaatttgccactggattgaatgagctagtgtttattatgtcacagctccacaaatggagcaaaccacaacctgttgacgagttgccattgaatttgtctttgaatccagtttacattgagagaattcctttgggaacaattttagtcattgctgctttcaattatccgttttttgtctcgatctcaccaatagttggtgcaatagcaagtggcaacacagttgcactcaagccttctgagttaacaccccgtttttccaagctttttactgacttgttgtcaaaagcattggacccagagatattttttgttgtcaatggggccattcctgaaacaacatgcttgttggaacaaaaatttgacaaaattgtttatactggtagcggtttggtaggtacaataattgcgaaaaaggctgcggaaaccttgacaccagttattttggagttgggaggaaagtcacctgcttttgttttggatgacatttctgacaaggacttggcaactgttgctcgaagaattgcttggggtagatttgtaaatgctggtcaaacatgtatcggtgttgactatgtattggtggcaaagtccaagcacgacaaatttatcctggccttgcaagaggtaattgaaaaagagttttttcaagacgttgacaagacgagaaactttacccatatgatccatgaccgggcatttgagaaaatggagagtatactcaacactacttctggtaatgtgataattggaggcaagcttgatcatggcacaagatatgtgggacctaccgtgattgataacgtaacctggacagattcctctatgaaagacgagattttcggtccaattttaccaattttaacctacactgatcttgaaaaatcctgtcgtgaaattattgctaaccacgatactcccttggcacaatatatctttacaagtggacctacatctagacagtataattcccaaattaacactattaccactttggttagatctgggggattggttatcaatgacgttttgatgcatattgctttgcacaatgctccgtttggtggtgttggaacttcgggaaacggtgcctatcatggagagttctcatacagagctttcacacatgagaggaccgttctcgaacaacatttgtggaatgattgggtactcaaatcaagatatcccccatatgccaataaaaaagacaaattgatcgccagctcccaacaaaagtacggtggtagagtttggttcaatagagaagggaatgtgagaattggaggtccacccctcttgttttctgcttggaacaatgctcttggggtagctgaattagtacgtgattttattggagctggtttgtga

SEQ ID NO: 554 - protein, 661 aa, Candida albicans
MSKPSSIKKSKASAIKPSANSKSKTPKIETPKLQQVETRLEGEVPTTKVSIKRNSITTESVKASEDKSTPQSTNTPAAAVAKSNPNTNAEPAKIPNEKSLKTESPSSQKQNGATTTKEKSDVSLETKSTSSTTVSNNNSVLQYTELSEIPIGVERITKAFHSGKTHSLQFRLKQLRNLYFTMKDNQEALCDALQKDFHRLPSETRNYEFATGLNELVFIMSQLHKWSKPQPVDELPLNLSLNPVYIERIPLGTILVIAAFNYPFFVSISPIVGAIASGNTVALKPSELTPRFSKLFTDLLSKALDPEIFFVVNGAIPETTCLLEQKFDKIVYTGSGLVGTIIAKKAAETLTPVILELGGKSPAFVLDDISDKDLATVARRIAWGRFVNAGQTCIGVDYVLVAKSKHDKFISALQEVIEKEFFQDVDKTRNFTHMIHDRAFEKMESILNTTSGNVIIGGKLDHGTRYVGPTVIDNVTWTDSSMKDEIFGPILPILTYTDLEKSCREIIANHDTPLAQYIFTSGPTSRQYNSQINTITTLVRSGGLVINDVLMHIALHNAPFGGVGTSGNGAYHGEFSYRAFTHERTVLEQHLWNDWVLKSRYPPYANKKDKLIASSQQKYGGRVWFNREGNVRIGGPPLLFSAWNNALGVAELVRDFIGAGL

SEQ ID NO: 555 - DNA, 411 bp, Candida albicans
atggctagaacaaaacaaacagcaagaaaatctactggtggtaaagccccaagaaaacaattagcttccaaagctgctagaaaatctgctccatctactggtggtgtcaagaaaccacacagatataagccaggtactgttgccttgagagaaattagaagattccaaaaatctactgaattattgattagaaaattaccattccaaagattagtcagagaaattgctcaagatttcaaaactgatttaagattccaatcttctgctattggtgctttacaagaagccgttgaagcttacttggttggtttattcgaagatactaacttgtgtgctatccatgctaagagagttaccattcaaaagaaagatatgcaattagctagaagattgagaggtgaaagatcttag

SEQ ID NO: 556 - protein, 136 aa, Candida albicans
MARTKQTARKSTGGKAPRKQLASKAARKSAPSTGGVKKPHRYKPGTVALREIRRFQKSTELLIRKLPFQRLVREIAQDFKTDLRFQSSAIGALQEAVEAYLVGLFEDTNLCAIHAKRVTIQKKDMQLARRLRGERS

SEQ ID NO: 557 - DNA, 1086 bp, Candida albicans
atgaaagcagctatcatttctggatctttcgaaccttatcaattagcggaaattaaagatattcctcaacaaaaaataaaagaaaatgaaatattaatcaaagcagtagcttttgcaataaacccaactgattggaagcacattgtttatcaattgggcagcccaggtgatgttgttggttgcgatgttagtgggatcattgaagaagtgggttctcaagtaactgggtttgcaaaaggtgacactgtaagtgcttttataactggtaatagatcacctcgcactggagcttttgcagaatatgtagctgttgatcctgctacttcgataaagtacaataagaattttgaacatttgactaatttacaagtatctgaaatccactcatttgaaggggcagcaagtattaatttaggtttggttaccgttgggctttcattttctcattacttacgaattgacaacaaaaagcaacctggggatagtattttgatttggggaggagcaactgcaactggagttctagccattcaggttgccaaactagtgtataatctcaaagtaatcaccacagcatcacccaaaaaccacaccctcttgaaacaattaggggcagattatgttttcgattatggagacgctgatgttgtcaataaaattaagaatattggccaaattaaatttgctcttgatacgattgcaacaccagaaacgtttcaaaaagtttacgactcaacagaggggtctcaagaagtatttattgattccttagcaggtttagactatcgatcaattgctgccaatgatgccagaggagatcaagtacattgggggcacaccattgcttgtttggcatctttaaaagagaaaactgtgtttaatgaaaattatgttcaaacacctgaattgttagatgattttactcagtggtggcaaaaggtggtccctcaaataattgatcgtattaaacatacaaatttaaagttattaaatgaaggattagactccgtaagtgaagggttagaattgtctagaaataataaactctctgctgaaaaggttgtatttagagttctggatctgtga

SEQ ID NO: 558 - protein, 361 aa, Candida albicans
MKAAIISGSFEPYQLAEIKDIPQQKIKENEILIKAVAFAINPTDWKHIVYQLGSPGDVVGCDVSGIIEEVGSQVTGFAKGDTVSAFITGNRSPRTGAFAEYVAVDPATSIKYNKNFEHLTNLQVSEIHSFEGAASINLGLVTVGLSFSHYLRIDNKKQPGDSILIWGGATATGVLAIQVAKLVYNLKVITTASPKNHTLLKQLGADYVFDYGDADVVNKIKNIGQIKFALDTIATPETFQKVYDSTEGSQEVFIDSLAGLDYRSIAANDARGDQVHWGHTIACLASLKEKTVFNENYVQTPELLDDFTQWWQKVVPQIIDRIKHTNLKLLNEGLDSVSEGLELSRNNKLSAEKVVFRVSDS

SEQ ID NO: 559 - DNA, 798 bp, Candida albicans
atgacgtcttcatcttctcaaaaatctgttggatcttcaatcatagatgcaaaccaaggaccaataaaaaaagttgaaattgctggagagggtggtgaatttgttattatcaatcgtcacaagtactacagacatgacttgatggctgccttcgggggtactttaaacccaggtgcttctccttggccaaagatcaatatcaaccctgctcccctcgggttatgtgggtttgccatgaccacttttgtcttatccctttacaatgcccaagctatgggtatcaaagttccaaatgtggtagtttcacttgcatgtttctacggtggtgcagctcaattttttgctggatgttttgagtttgtgactggaaatacatttggtatgactgcattgacatcttacggtgccttctggttgagttattcagcaatcttggttgatagttttggtatcgctgcagcctacgaagcttctgaagaaacagcttcacagttaccaaatgccattggatttttcttacttgcttggggtatctttacatttatgttgtggttgaacactttaaaatctacagttactttcagttccttgtttttcttattgtttgtaacattccttttgttagctggtggtgaatttagtggaagagtcggtgttactagagctggtggtgtttttggtgttatcacagccattgttgcttggtggaatgccttagccggtactgctactccaaccaactcttacttccaacctgtttctattccattgccaggtaacgttgttttcaagaaatag

SEQ ID NO: 560 - protein, 265 aa, Candida albicans
MTSSSSQKSVGSSIIDANQGPIKKVEIAGEGGEFVIINRHKYYRHDLMAAFGGTLNPGASPWPKININPAPLGLCGFAMTTFVLSLYNAQAMGIKVPNVVVSLACFYGGAAQFFAGCFEFVTGNTFGMTALTSYGAFWLSYSAILVDSFGIAAAYEASEETASQLPNAIGFFLLAWGIFTFMLWLNTLKSTVTFSSLFFLLFVTFLLLAGGEFSGRVGVTRAGGVFGVITAIVAWWNALAGTATPTNSYFQPVSIPLPGNVVFKK

SEQ ID NO: 561 - DNA, 630 bp, Candida albicans
atgtctgaagaattagctcaaaaaactgaagaattgtcattagattccaagactgtttttgattccaaagaagaatttaatgcaaagcatccattgaacagtagatggacattatggtacactaaaccacaaaccaacaagagtgaaaactggcatgatttattaaagccagttataactttctcatctgttgaagaattttggggaatttacaactcgattccaccagcaaatcaattacctttgaaatcagattatcatttgttcaaagaaggaattagaccggaatgggaagatgaggctaactcaaaaggtggtaaatggcaattctccttcaacaaaaaactggaagtcaatccaatcataaatgatttgtggttaagaggtttgttggcagttattggtgaaaccattgaggatgaagaaaacgaagtcaatgggattgtgttgaatatcagaaagcaagcttacagagtcggtatttggaccaaagattgtgatgaatccaaattaaagactgtcggtgagagattgaagaaagtcttgcaattaaacgatgaacaaaaagttgaattcatgtcgcatgatgcttccaatactagaggcgctgaacctcaaattgttttgtaa

SEQ ID NO: 562 - protein, 209 aa, Candida albicans
MSEELAQKTEELSLDSKTVFDSKEEFNAKHPLNSRWTLWYTKPQTNKSENWHDLLKPVITFSSVEEFWGIYNSIPPANQLPLKSDYHLFKEGIRPEWEDEANSKGGKWQFSFNKKSEVNPIINDLWLRGLLAVIGETIEDEENEVNGIVLNIRKQAYRVGIWTKDCDESKLKTVGERLKKVLQLNDEQKVEFMSHDASNTRGAEPQIVL

SEQ ID NO: 563 - DNA, 888 bp, Candida albicans
atgccagctcaattgcaagttaacactgattatttcactttaaacaatggaaacaaaatcccagctgttggattaggtacttggcaagcaaccaatgaagacgaagcttacagagccgtcttagcagctcttaagaacggatacaagcacattgataccgctgcaatttatggaaatgaagaacaagtcggtaaagccatcaaggactctggagttccaagagaagaattgtttgttactactaaattgtggaatgctgaccataaaaatattgaagaagccttagagacttcattgaaaaaattgggtcttaactatgttgacttgtacttgatccattggccagcttcaattgacaagtcaactaataaaccatatactgattttgattatgttgatacttatagaggtttacaaaaagtttataagaacagcaagaaaatcagagcaattggtgtttctaatttcaccaaaaagaaattggaaaggttattgtcttcggaaggtgtcgatgttgttcctgctgtcaaccaaattgaagctcacccattgttgactcagcctgaattgtatgattatttgaaagaaaaaggtatcgttttggaagcttattcaccattgggttctacaaactctccattattcaagaacgaaaccatcgttaaaatcgctgaaaagaatggtgttgaaccagctcaagttttggtatcttgggcaattcaaagaaagactgtggttttgcctaaatccgtcaccgaatcaagagttatttctaacttgaaaacattcactttaccttcagaagatttcgaaacattgaacaaattgtctgaaaaagatggtgttgtcagaacttgtaacccagctttcaacaactttgatgattaa

SEQ ID NO: 564 - protein, 295 aa, Candida albicans
MPAQLQVNTDYFTLNNGNKIPAVGLGTWQATNEDEAYRAVLAALKNGYKHIDTAAIYGNEEQVGKAIKDSGVPREELFVTTKLWNADHKNIEEALETSLKKLGLNYVDLYLIHWPASIDKSTNKPYTDFDYVDTYRGLQKVYKNSKKIRAIGVSNFTKKKLERLLSSEGVDVVPAVNQIEAHPLLTQPELYDYLKEKGIVLEAYSPLGSTNSPLFKNETIVKIAEKNGVEPAQVLVSWAIQRKTVVLPKSVTESRVISNLKTFTLPSEDFETLNKLSEKDGVVRTCNPAFNNFDD

SEQ ID NO: 565 - DNA, 381 bp, Candida albicans
atgtcttggcaagcctacactgataacttaattgctaacggtaaagtcgataaagcagccttatattcaagagccggtgacgcattatgggcccaatcgggatcattcgaattacaacaaccagaaatcactgaaattgccaaaggtttcgatagtgctgaaggtttgcaaaccagcggtttacacgttcaaggccaaaagtactttttgttaagagctgacgacagatcaatttatggtaaacacgaagccgagggtgttatttgtgttagaactaaacaaactattttgatcgcccattatccaagtggtgttcaaccaggtgaagctaccactcttgttgaaaaattagccgattacttgatcaatgtcggttattag

SEQ ID NO: 566 - protein, 126 aa, Candida albicans
MSWQAYTDNLIANGKVDKAALYSRAGDALWAQSGSFELQQPEITEIAKGFDSAEGLQTSGLHVQGQKYFLLRADDRSIYGKHEAEGVICVRTKQTILIAHYPSGVQPGEATTLVEKLADYLINVGY

SEQ ID NO: 567 - DNA, 993 bp, Candida albicans
atgtcaacaactgcaactagcacaaatgaattggcccttttggataagtcagtagtagtttctccgttggttttactatctgtggtggaccattataatagagttgccaaagattctaagaagagagttgttggggtaatattaggagataactctactgacacaatcaaagttacaaactcgtacgcaattccttttgaagaagacgagaagaaccctggagtatggtttttggaccacaattttatagattcaatgggagaaatgtttaaaaaaattaatgccaaagagaaattgattggctggtaccattcaggacctaaattgaaaccatcagatttgaaaattaatgaggttttcagaagatacaccgacaacccattgttgttaattgttgacgttcaaccaagagaagttggtattccaacagatgcatattttgccgttgatgatattaaaaacgatggctctgctgctgaaaagacatttattcatgtcccttccttgattgaagcagaagaagctgaagaaattggagttgaacatttgttaagagacatcagagaccaagctgctggtaacttgtccttaagagtttctgaaacacatcaatcattattgggtttacatcagaagcttggagaaattgcaaattatttggataaggtttaccaaaagaaattacctatgaatcatactattttggggaaattacagaatgtttttaatttgttgccaaacttgatgcaacaactggggagtgatctcgatggtggttcagactcgtctcatgcattagccactgcatttactgtcaagacaaatgacgaattgatgatcatatacattagtacattagttcgagctattattgcattccatgatttgatcgaaaacaagttagaaaataaaaagttgaacgaaaataaagcacaagcttccgtggctgaactgtcattaaatagcgaaaagaaagattctatagaagattaa

SEQ ID NO: 568 - protein, 330 aa, Candida albicans
MSTTATSTNELALLDKSVVVSPLVLLSVVDHYNRVAKDSKKRVVGVILGDNSTDTIKVTNSYAIPFEEDEKNPGVWFLDHNFIDSMGEMFKKINAKEKLIGWYHSGPKLKPSDLKINEVFRRYTDNPLLLIVDVQPREVGIPTDAYFAVDDIKNDGSAAEKTFIHVPSLIEAEEAEEIGVEHLLRDIRDQAAGNLSLRVSETHQSLLGLHQKLGEIANYLDKVYQKKLPMNHTILGKLQNVFNLLPNLMQQSGSDLDGGSDSSHALATAFTVKTNDELMIIYISTLVRAIIAFHDLIENKLENKKLNENKAQASVAESSLNSEKKDSIED

SEQ ID NO: 569 - DNA, 1122 bp, Candida albicans
atgactacttcccttacagaacaaactgctattttggccaaatatttggaattgtctcaaaatggtaaaatcttagctgaatacgtctggattgatgctgaaggtaacactagatccaaatgtagaactttatccaaaaaaccaactagtgttgatgatttacctgaatggaattatgatggttcatctactggtcaagctccaggccatgattctgatgtgtatttaagaccagttgctttttatcctgatccatttagaaaaggtgacaatatcattgttttaaatgaatgttggaacaatgatggtactccaaacaaatttaatcatcgtcatgaatgtgctaaattgatgaaggctcatgctagtgaagaagtttggtttggtttagaacaagaatatactttatttgatcaatatgattatccttatggttggccaaaaggtggattcccagctcctcaaggtccattctactgtggggttggtactggtaaagttgttgctagagatgtcattgaagctcattatcgtgcttgtctttatgctggtatcaacatttctggtattaatgccgaagttatgccatctcaatgggaattccaagttggtccatgtgaaggtattgaaatgggtgatcaattatggattgctcgttatttattacaaagagttgctgaagaatttgccgtcaagatttccttccatccaaaacctttgaaaggtgattggaatggtgctggttgtcatactaatgtttctaccaaatctatgagagtgcctggtggtatgaaagttattgaatctgctttgagtaaattggccaaaagacacaaggaacatatgttattgtatggtgccgataatgatcaaagattaactggtcgtcatgaaactggtcatatggatactttttcatcaggtgttgctaacagaggtgcatctatcagaattccaagacaagttgctaaagaaggatatggttatttcgaagatagaagaccagcttctaacattgatccatacttggtcactggtatcatggtggagacaatctgtggttctattccagatgctgatatggctaaagaattccttagagaaagcagtgatgataactaa

SEQ ID NO: 570 - protein, 373 aa, Candida albicans
MTTSLTEQTAILAKYLELSQNGKILAEYVWIDAEGNTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 571 - DNA, 900 bp, Candida albicans
atgccagttgaagagcttgaagaccgtgttatcattactgatccaaatgactcaactaacagagccaccattttgaaatttggtgctactgtagtttcttggaaaaacaataatcaagaaaaattgtggttatcagaaggtgctcatttagatggaagtaaagccgttagaggtggtatcccattagttttcccagttttcggtaaacaaaaagattcaaatcatccaactttcaaattacctcaacatggatttgctcgtaattcaacttgggaattcttgggacaaactcaagaaagtcctattacggttcaatttggattaggtccagaaaatgttgatccagaaactttgaaattatggaattatgatttcactttgattttaactgttagtttgactaaagataaattggttacttcaattgacgtggaaaacactggtaaagaagcatttgaatttaattggttgttccatacatattatagaatccatgacatcaccgatacattagttaccaatttaattgaccaacaatgttacgatcaattgattggtgaatcatatatcgaaaaggcaccagttatcagtttccatgaagaatttgatagaatttattcaaaagtcagtttggaaaaatccattcaagtcgttgataaaggtcaagttcttttcaatcttcatagaaaaaacttgcctgattccgttgtatggaatccatggactaagaaagctgaaggtatggctgatttccaaccaaaatcagggtttcatcaaatggtctgtgttgagccaggtcatgttaactcaatggtctctttaccagctggtgggaaatggtcaggtggtcaagaaatcactattggcggtgagattaaagttcaagctaatatttattag

SEQ ID NO: 572 - protein, 299 aa, Candida albicans
MPVEELEDRVIITDPNDSTNRATILKFGATVVSWKNNNQEKLWLSEGAHLDGSKAVRGGIPLVFPVFGKQKDSNHPTFKLPQHGFARNSTWEFLGQTQESPITVQFGLGPENVDPETLKLWNYDFTLILTVSLTKDKLVTSIDVENTGKEAFEFNWLFHTYYRIHDITDTLVTNLIDQQCYDQLIGESYIEKAPVISFHEEFDRIYSKVSLEKSIQVVDKGQVLFNLHRKNLPDSVVWNPWTKKAEGMADFQPKSGFHQMVCVEPGHVNSMVSLPAGGKWSGGQEITIGGEIKVQANIY

SEQ ID NO: 573 - DNA, 3519 bp, Candida albicans
atggatggtggcgatacttatatatgtataaaacaatttaatgccagattaggcgatgaattgagtcttaaaattggcgacaaaattcaagtattggctgacgatagagaatataatgatggttggtacatgggcaaaaacttgttgactggagaagcaggcttatatccaaaaacatttactcaattaataaccaacaatgatagtaaaacacttcttagatcgaggtcaagaagaatgatggcacctaaaagttccgaccaagaaacaacaccaaaggacaccactactcccgtggtgtcgagtaatctcaatcccaacactcctccaaattaccctccaacattgtcatcttcaacagaaccttcccatttagctgaaccaatgtctcagttaaatttaaataaagattctcaatcttctcaatatactgggtctcatttgaacagccaaattgatagagcattacaagaacttcaagggtctaatgccgacttgaccaattctggcaatagttttaatgagcacagaaaccaccactacaataacaacactaataataataataataataataataatgctgctactagtaataattacaaacaaccacagttaatgtcgaagaaatcaaatgatagtctttctagtcaatatcaatatcaatcacaatcccaacaaccaaaacatttgagtggagataaatctcgacaatccttaactgacgatttggaccctttgaaagcaaatacttggacaccaaagcaagtttcttcttattttgccttggtgttagggtttgatatggatgtggctgggaaatttgctcaacacaaaatcactggagaaatcttgtttgaattggatttaaatcttttgaaagaattggatattgattcatttggtaccagattcaaattatataaagaaattgggaaattaaaggaattgaatactgaaggagttaaagataaacaattgagaacagattctctgtcgactggatcaactggtaaaaatgacactacgtcatcagcattaaattctccaccaactgcttccacaactttacacgatgccgtgcctcatatcgatgataataatatgttaaataatactggcaaacaacaaacacaactaatgccatcagccgttttgaccaacacttctgactacaataataatagtcaacaacaaagtggttctcaacatcatcagaggaaaaggtcactgtcggtggatgttgccccacaacaatacttggcttctgattctacatttatgtcgcctagaagagctcctcaaccaccatctggtgagagcccaattgatacaagttataaatttggtgctggaagcgaatacgatagaccaccttcacactatggcatgtacatgacacgtactaacgcttcaagtcatgccttgggaagttcatcaccaggaatcaactcacgaccagcttcatcaatttatgatctgttttccaatcataatagaaatggatcatcaacttcaaaacaacaccacaagagaaattcatcagtaaccaacaataacaataacaataacggtaacagcaaccacaagcatcatcacagacgtcattcttcggtattctcatacctttcgtctggtaatgatgattcggcaaaaccaacaccaaaattattgagtagtaagttccaaagtaacaatttgtacaagggtggtgatgatggtcatggagatttcacttcttcaagcaataacaacaacaataacagtaagttagtgtcgccagcccagatcaagagagaaaccactagtggtcaatcgtctcttcatgaatcaggatccaaatcgaaaggaaaatcacaaatttttgatttatccaattcaccagttgatattgatgatgccaagttttctccaaaaaaactgaattccgtatcagttcgcaccaagtcaatggatgcaattggtggtaatggagacgatagacgtgttgctagtgattctacaggattgagtcaatcaaaacctaataattcatcaagacttaaaggcattcgtgccacgtcaactcaaagtttccgaagtttaacagggtcgaagaaactgaaaacatcagcatttcaagaaggtatacgtgagattactcctgatgaagccattaaaactgccagtcatagtggttatatgtctaaacgttcaaataacaatttagcgtggagaacaagatatttcacattacacggtaccagattatcatatttccaatctttgaaagataaaaaggaaaaaggtttgattgatattactgctcataaagtgatacctattgatagtgctagtgatgatactgataaagctgatagatatgctgcgatgtatgcctcgacaacatttgctggtaattattgttttaaattggttccaccggctccagggtttaaaaaggggttaacgtttacgcaaccgaaaactcattattttgctgttgaaacagaagaagaaatgagagcttgggtcaaagcattaatgcaagccactattgatattgatgattctgttcctgttgtgagtagttgttctaccccaactgtcagtttgaataaagctcaagaattgttagctaaagccagagaagaaaccaaattacgagatgaacaactaaaagctaatggctacattagaagcttagaagatatcaatgatacttcatttctggcatctttggattatcctgatatgagtggagatattggttttggtagtacttctccagtagcagcaacttcagcacctaaattgactcttgatactaattttaataggaaaagttctggaactatgggaacaacggggacaataggtactccaggaacatcaggtggtacggtaccaacaacaccacaaataccacgatcatcaagtcaaagtggtgggtttgcttcaccttatttattagcttctgggttattatcacccaaatcaggaggtggtgccggtccaggaggaattgtatcatcgtcttctccaattaatgaaaatggacctttaagaaattcaacttcaaattcagaatattttggtgatattacttataaaagtttaaaaccaccatctcgacaaaattcccaatatgcaagtatcactagtggtggtggcagtattgggtttggatatggttccaacaatagtggcctaggtggaccagcaacagcaattggaggaggaggaggaggagtattatcatcatccactccatattctactggttctggatcaacagcaagttcaatgaattataataatcataacaacaacaacaacaacaacaattctgttaatagtccgattaatgaatttagatcttcaagggatttgaaatcatcatcgtcaccaacgacaacaacaggtacatcttcaacatcagggaaaaaaccccaatcacgtagaacatcagataaaatgttgggattttcaagtgatgcttcaggtagtcatacttttgttattaaaccgaaaaaataa

SEQ ID NO: 574 - protein, 1172 aa, Candida albicans
MDGGDTYICIKQFNARLGDELSLKIGDKIQVLADDREYNDGWYMGKNLLTGEAGLYPKTFTQLITNNDSKTLLRSRSRRMMAPKSSDQETTPKDTTTPVVSSNLNPNTPPNYPPTLSSSTEPSHLAEPMSQLNLNKDSQSSQYTGSHLNSQIDRALQELQGSNADLTNSGNSFNEHRNHHYNNNTNNNNNNNNNAATSNNYKQPQLMSKKSNDSLSSQYQYQSQSQQPKHLSGDKSRQSLTDDLDPLKANTWTPKQVSSYFALVLGFDMDVAGKFAQHKITGEILFELDLNLLKELDIDSFGTRFKLYKEIGKLKELNTEGVKDKQLRTDSSSTGSTGKNDTTSSALNSPPTASTTLHDAVPHIDDNNMLNNTGKQQTQLMPSAVLTNTSDYNNNSQQQSGSQHHQRKRSSSVDVAPQQYLASDSTFMSPRRAPQPPSGESPIDTSYKFGAGSEYDRPPSHYGMYMTRTNASSHALGSSSPGINSRPASSIYDSFSNHNRNGSSTSKQHHKRNSSVTNNNNNNNGNSNHKHHHRRHSSVFSYLSSGNDDSAKPTPKLLSSKFQSNNLYKGGDDGHGDFTSSSNNNNNNSKLVSPAQIKRETTSGQSSLHESGSKSKGKSQIFDLSNSPVDIDDAKFSPKKSNSVSVRTKSMDAIGGNGDDRRVASDSTGLSQSKPNNSSRLKGIRATSTQSFRSLTGSKKSKTSAFQEGIREITPDEAIKTASHSGYMSKRSNNNLAWRTRYFTLHGTRLSYFQSLKDKKEKGLIDITAHKVIPIDSASDDTDKADRYAAMYASTTFAGNYCFKLVPPAPGFKKGLTFTQPKTHYFAVETEEEMRAWVKALMQATIDIDDSVPVVSSCSTPTVSLNKAQELLAKAREETKLRDEQLKANGYIRSLEDINDTSFSASLDYPDMSGDIGFGSTSPVAATSAPKLTLDTNFNRKSSGTMGTTGTIGTPGTSGGTVPTTPQIPRSSSQSGGFASPYLLASGLLSPKSGGGAGPGGIVSSSSPINENGPLRNSTSNSEYFGDITYKSLKPPSRQNSQYASITSGGGSIGFGYGSNNSGLGGPATAIGGGGGGVLSSSTPYSTGSGSTASSMNYNNHNNNNNNNNSVNSPINEFRSSRDLKSSSSPTTTTGTSSTSGKKPQSRRTSDKMLGFSSDASGSHTFVIKPKK

SEQ ID NO: 575 - DNA, 2028 bp, Candida albicans
atgtcaaacgaatatattcttgttactggtggtgcaggttacattggttctcatacagttattgaattaatcagtaatggatataaagtagtcattgttgataatttaagtaattcttcctatgatgcagttgctagaattgaattcattgtcaaacaacatgttccattctatgatgttgatatcagaaattatgagcaattgaataaagttttccaagattataagatctctggagtcattcattttgctgctttgaaagctgttggtgaatcaacaaaaatccccttagcatattatgataataatgtatcaggtactgtcaacttattggaagtatgtaaagccaatgatgtgaagacaattgttttcagttcttcagctactgtctatggtgatgttactagatttggtgataattcaatgattcctatccctgaacattgtccaatggatccaacaaatccatatggaagaacaaaattcattattgagtcgattttaaaagatatttataatagtgatgatgcttggaaagtagcaattttgagatatttcaacccaattggtgctcatccatctggtttattaggtgaagatccattggggatcccaaataacttattaccttatttggctcaagttgctataggtagacgtgaaaaattgtctattttcggaaatgattataatagtcgtgatggtacccctattagagactatattcatgtggttgatttggcaaagggtcacattgctgcattggcgtatttgaaaaacttgcaatctaaaggcttgtatcgtgaatggaatttaggtactggtaaaggatccactgtttttgaagtttatcatgcatttagtaaagttgttggtagagaattgccccatgaagttgttggaagacgtgctggggatgtcttggatttgactgctaagccagacagagcaaacaaggaattgcaatggaaaactgaacttaccattgatgatgcttgtaaagatttatggaaatggactactgagaacccttttggattcaacattgagaattattcttggaaagaatttgatgggttcaataaccgtttgcacagttttgttgctggtgacttgaaagttaacttagcgaatcgtggtgcattgatccaagctatcacgttgaaggattccaatatggtcaaagcttataataatgctgaagatttcaaatctgaaactaacccatttttcggtaccactgttggtagatatgccaatagaatttccaatggagaatttaaattgaatggaaaagtgtacaaattaactaaaaatgaaggagcaaacaacttgcatggtggtgcaaatggattcgataaacaagatttctttggtccagttgtgaaaagtcgtgatggtaagtttttcgttgatttcttgttggttgataaagatggtaatgatgggttcccaggtgagcttgaagctatcgtacattacacaattgatgactcctcagtggaaattgaatatgaatgtcaattattatctggtgaagcaacaattgtcaatatgactaaccatagttatttcaatgtttccaactcagacactattgaaggaaccgaggtaaaattgattactgataaaatgttagaagtggattcacaattattaccaactggtaaatttattgaaaatgaaaaagctgctagcccaattgtgttaaatgagaatgacgtatttgacaattgttttattgttgatgaagaatgtggtatagatactcgtgataaacctttgaaacaagtctttgaagcaactagttttgtcacaaacaacaaattgaagatatccaccactgaaccagctttccaattttacactggtgacggtgttaatactaaaggttttgggaaaagatgtggtttctgcgtggaaccaagtagatttattaatgcaatcaatcacaaagaatggtctaatcaagtcatcttgaaaaaaggtgatgtttatggaagtaaaattaaatatgaatttcaatag

SEQ ID NO: 576 - protein, 675 aa, Candida albicans
MSNEYILVTGGAGYIGSHTVIELISNGYKVVIVDNLSNSSYDAVARIEFIVKQHVPFYDVDIRNYEQLNKVFQDYKISGVIHFAALKAVGESTKIPLAYYDNNVSGTVNLLEVCKANDVKTIVFSSSATVYGDVTRFGDNSMIPIPEHCPMDPTNPYGRTKFIIESILKDIYNSDDAWKVAILRYFNPIGAHPSGLLGEDPLGIPNNLLPYLAQVAIGRREKLSIFGNDYNSRDGTPIRDYIHVVDLAKGHIAALAYLKNLQSKGLYREWNLGTGKGSTVFEVYHAFSKVVGRELPHEVVGRRAGDVLDLTAKPDRANKELQWKTELTIDDACKDLWKWTTENPFGFNIENYSWKEFDGFNNRLHSFVAGDLKVNLANRGALIQAITLKDSNMVKAYNNAEDFKSETNPFFGTTVGRYANRISNGEFKLNGKVYKLTKNEGANNLHGGANGFDKQDFFGPVVKSRDGKFFVDFLLVDKDGNDGFPGELEAIVHYTIDDSSVEIEYECQLLSGEATIVNMTNHSYFNVSNSDTIEGTEVKLITDKMLEVDSQLLPTGKFIENEKAASPIVLNENDVFDNCFIVDEECGIDTRDKPLKQVFEATSFVTNNKLKISTTEPAFQFYTGDGVNTKGFGKRCGFCVEPSRFINAINHKEWSNQVILKKGDVYGSKIKYEFQ

SEQ ID NO: 577 - DNA, 1194 bp, Candida albicans
atgagaggtatcaaaggtttagtttgggaaggttctgttttggacccaattgaaggtatccgtttcagaggaagaaccatcccagacattcaaaaagaattgccaaaagcaccaggtggtgaagaaccattaccagaagctcttttctggttgttgttgactggtgaagttccaactgacgcccaaactaaggctttatccgaagaatttgctgctagatcagcattaccaaagcacgttgaagaattgatcgacagatctccatctcacttgcacccaatggctcaattctccattgccgttactgctttggaatctgaatcccaatttgcccaagcttatgctaaaggtgccaacaaatccgaatactggaaatacacttacgaagattccatcgatttgttagctaaattgccaaccattgctgctaagatttacagaaacgttttccacgatggtaaattgccagctgccattgactccaaattggattacggtgctaacttggccagtttgttaggttttggtgacaacaaggaatttgttgaattaatgagattgtaccttaccatccactctgaccacgaaggtggtaacgtctctgcacacaccacccacttggttggttccgctttatcttccccattcttgtcattagctgctggtttgaatggtttagctggtccattacacggtagagctaaccaagaagttttggaatggttgttcaaattaagagaagaattaaacggtgactactccaaggaagccattgaaaaatacttgtgggaaaccttgaactccggtagagttgtcccaggttacggtcacgctgtcttgagaaagaccgatccaagatacactgctcaaagagaatttgctcttaaacatatgccagactacgaattgttcaaattggtttcaaacatttacgaagtcgctccaggtgttttgaccaaacacggtaagaccaagaacccatggccaaatgtggactcccactctggtgtcttgttacaatactacggtttgactgaacaatctttctacactgtcttgttcggtgtttccagagcctttggtgtcttgccacaattgatcttggaccgtggtatcggtatgccaattgaaagaccaaaatctttctccactgaaaaatacattgaattggtcaaaaacatcaacaaagcttaa

SEQ ID NO: 578 - protein, 397 aa, Candida albicans
MRGIKGLVWEGSVLDPIEGIRFRGRTIPDIQKELPKAPGGEEPLPEALFWLLLTGEVPTDAQTKALSEEFAARSALPKHVEELIDRSPSHLHPMAQFSIAVTALESESQFAQAYAKGANKSEYWKYTYEDSIDLLAKLPTIAAKIYRNVFHDGKLPAAIDSKLDYGANLASLLGFGDNKEFVELMRLYLTIHSDHEGGNVSAHTTHLVGSALSSPFLSLAAGLNGLAGPLHGRANQEVLEWLFKLREELNGDYSKEAIEKYLWETLNSGRVVPGYGHAVLRKTDPRYTAQREFALKHMPDYELFKLVSNIYEVAPGVLTKHGKTKNPWPNVDSHSGVLLQYYGLTEQSFYTVLFGVSRAFGVLPQLILDRGIGMPIERPKSFSTEKYIELVKNINKA

SEQ ID NO: 579 - DNA, 1653 bp, Candida albicans; identical to SEQ ID NO: 475

SEQ ID NO: 580 - protein, 550 aa, Candida albicans; identical to SEQ ID NO: 476

SEQ ID NO: 581 - DNA, 1194 bp, Candida albicans
atggcatccgaaggtattactgaaatcgactctggtttaattgaaaccaattacgataacgtcgtctacaagttcgacgatttaaacttgaaaccaaacattgttagaggtatttttggttacgggtatgaaactccatccgctattcaacaaagagccatcttgccaatcactgaaggtagagatgttttggctcaagctcaatccggtactggtaaaaccgctacctttaccatttctgcattacaaagaatcaatgaaaatgaaaaagccactcaagctttaatcttggccccaaccagagaattggctttgcaaatcaagaatgttatcactgctattggtttgtacttgaaggttactgtccatgcttctattggtggtacctcaatgagtgacgatattgaagctttcagatctggtgttcaaattgtcgttggtactccaggtagagtcttagacatgattgaaagaagatatttcaaaaccgataaagtcaagatgttcattttggatgaagctgatgaaatgttatcaagtggatttaaagaacaaatttacaacattttcagattattaccagaaaccacccaaattgtcttattatctgccaccatgccacaagacgttttggaagtcaccaccaaattcatgaacaacccagtcagaatcttagtcaaaaaagatgaattgactttggaaggtatcaaacaattctatattaatgttgaattagaagattacaaattcgattgtttgtgtgatttgtacgattctatttctgtcacccaagccgtcattttctgtaacactagatccaaggttgaatttttaaccaacaaattgagagaacaacactttactgtctctgccatccacgctgatttgccacaagccgaaagagacaccattatgaaagaattcagatctggttcttcaagaatcttgatctctactgatttgttagctagaggtattgatgtccaacaagtttctttagttatcaactacgatttgccagccaacaaggaaaactacattcatagaattggtagaggtggtcgtttcggtagaaagggggttgccatcaactttgtcactgacagagatgttggtatgatgagagaaattgaaaaattctactctactcaaatcgaagaaatgccagctgatattggtgctttatttgcttag

SEQ ID NO: 582 - protein, 397 aa, Candida albicans
MASEGITEIDSGLIETNYDNVVYKFDDLNLKPNIVRGIFGYGYETPSAIQQRAILPITEGRDVLAQAQSGTGKTATFTISALQRINENEKATQALILAPTRELALQIKNVITAIGLYLKVTVHASIGGTSMSDDIEAFRSGVQIVVGTPGRVLDMIERRYFKTDKVKMFILDEADEMLSSGFKEQIYNIFRLLPETTQIVLLSATMPQDVLEVTTKFMNNPVRILVKKDELTLEGIKQFYINVELEDYKFDCLCDLYDSISVTQAVIFCNTRSKVEFLTNKLREQHFTVSAIHADLPQAERDTIMKEFRSGSSRILISTDLLARGIDVQQVSLVINYDLPANKENYIHRIGRGGRFGRKGVAINFVTDRDVGMMREIEKFYSTQIEEMPADIGALFA

SEQ ID NO: 583 - DNA, 606 bp, Candida albicans
atggcgggaaagaaaaagtctaagtctgaagctttaccattagatttagacaatattaaaccaatggatcatttacaaccagtccctaaaacaagatcatcatcaattacctcaattgaaagtgctgatgaaccaggtactatgaaacaagtgttgttaccacctacaatcaaagaatttgacgaattggaacaatttgaatcatttgttcgtgatgaaacttgggataatgattttgattatttccatggtagattacattattatccaccatttgttatgaagagttgtcaaaataatcttgaaaaaatcaagcctaccatgaataaaaactccaagaaatttagacgtgatttacaacatcatattcaaaaacatttaattaaagatttagaaaaatgttgtggttacgagttgaattttggtaaaggagaagttgttgagactgataataaagttacttggaaatttaaagacgaaactgatcatggttttagtaaagaagaagaagatatgtatgatagacattggagattggaattggatgtttcttgtacaaatgaatcagctatggttgatgttgaatataaatccattccaatgtaa

SEQ ID NO: 584 - protein, 201 aa, Candida albicans
MAGKKKSKSEALPLDLDNIKPMDHLQPVPKTRSSSITSIESADEPGTMKQVLLPPTIKEFDELEQFESFVRDETWDNDFDYFHGRLHYYPPFVMKSCQNNLEKIKPTMNKNSKKFRRDLQHHIQKHLIKDLEKCCGYELNFGKGEVVETDNKVTWKFKDETDHGFSKEEEDMYDRHWRLELDVSCTNESAMVDVEYKSIPM

SEQ ID NO: 585 - DNA, 1662 bp, Candida albicans
atggctcctcctactgctgttgaatcttcaatcaatttcggaggtcacccaactatcaaatccactcaagacccattggtccaaaagttgtctcttaataccgacactgtgatcagacacaatgctccacctccaaccttatacgaagatggtttattagaaaaaggtactactatctcatctactggtgctttaatggcttactctggtaacaaaaccggtagatctcctaaagacaagagaattgtcgacgaatccacctcatcccataacatttggtggggtccagtgaataaacaagttgacgaattaacttggaagatttctagatcaagagctttggattacttgagaactagagaaaagttgtttgttgttgacgcttatgctggttgggatccaagatacagaatcaaggtcagaattatctgtgctagagcttaccatgctttgttcatgaccaatatgttgatcagaccaactgaagaagaattaaaaaactttggtgaaccagatttcaccatctacaatgctggtcaattcccagccaacatccacactaaaggtatgacttctgccacttctgttgaaatcaactttaaagatatggaaatggttatcttgggtactgaatatgctggtgaaatgaagaaaggtatctttactgttatgttctacttgatgccaatcaaacacaaggttttgactttgcactcctcatgtaaccaaggggttgaaaaaggtgatgtcactttgttctttggtctttctggtactggtaagaccactttgtctgctgatccacaaagaaagttgattggtgatgacgaacattgttggtccgacaatggtgtgttcaacattgaaggtggttgttacgccaaatgtttggacttgtctgctgaaaaagaaccagaaattttcaactccatcaagtttggtgctattttggaaaatgttgtctacgacccaatcaccaaggttgttgactacgaagattcatcaatcactgaaaacactagatgtgcatacccaattgatttcattccatctgccaagattccatgtttggccgacacccatccaaccaatattatcttgttaacatgtgatgcttccggtgtgttgccaccagtctccaaattgactaatgctcaagttatgtatcatttcatttctggttacacctccaagatggcaggtactgaagaaggtgttactgaaccacaagctacattctccgcatgtttcggtcaaccattcttggtgttgcacccaatgaaatatgctcaacaattgtctgacaagatttccgaacacaatgccaacgcttggttgttgaacactggttgggttggttcttctgttgctcaaggtggtaagagatgtccattgaaatacaccagagctatcttggatgctatccactctggtgaattgtctaaagtcgaatacgaaaaagttccagttttcaaccttaatgttccaacttcttgtcctggtgttccaagtgaaattttgaacccaactaaagcttggacccaaggtactgattcattcaacaaggaaatcaaatctcttgctaccaagtttgctgaaaacttcaagacatacgctgatcaagctactgctgaagttaaagctgctggtccagaagcataa

SEQ ID NO: 586 - protein, 553 aa, Candida albicans
MAPPTAVESSINFGGHPTIKSTQDPLVQKLSLNTDTVIRHNAPPPTLYEDGLLEKGTTISSTGALMAYSGNKTGRSPKDKRIVDESTSSHNIWWGPVNKQVDELTWKISRSRALDYLRTREKLFVVDAYAGWDPRYRIKVRIICARAYHALFMTNMLIRPTEEELKNFGEPDFTIYNAGQFPANIHTKGMTSATSVEINFKDMEMVILGTEYAGEMKKGIFTVMFYLMPIKHKVLTLHSSCNQGVEKGDVTLFFGLSGTGKTTLSADPQRKLIGDDEHCWSDNGVFNIEGGCYAKCLDLSAEKEPEIFNSIKFGAILENVVYDPITKVVDYEDSSITENTRCAYPIDFIPSAKIPCLADTHPTNIILLTCDASGVLPPVSKLTNAQVMYHFISGYTSKMAGTEEGVTEPQATFSACFGQPFLVLHPMKYAQQLSDKISEHNANAWLLNTGWVGSSVAQGGKRCPLKYTRAILDAIHSGELSKVEYEKVPVFNLNVPTSCPGVPSEILNPTKAWTQGTDSFNKEIKSLATKFAENFKTYADQATAEVKAAGPEA

SEQ ID NO: 587 - DNA, 1014 bp, Candida albicans
atggtcaaagtcgctattttaggagctgctggtggtattggtcaaccattatctttattgaccaaattaaacccaaatgttgatgaattggcattatttgatgtcgtcaatgttccaggagttggtgctgatttatctcatatcaattctgattctaaaactcaatcatatttaccaaaagataaagaagataaaactgcattagctgctgcattaaaaggttctgatttagtcattatcccagctggtgttccaagaaaaccaggtatgaccagagatgatttattcaatattaatgcatcaatcgttcaaggtttagctgaaggtattgctgccaattctccaaaagcttttgtcttggtgatttctaatccagtcaattctactgtaccaattgttgccgaaactttacaagctaaaggtgtttatgatccagctagattatttggtgttactactttggatattgttagagccaatacttttatttctcaattattcctagatcaaactaaaccatctgatttcaatattaatgttgttggtggccattctggtgaaaccattgttccattatattcattaggtaactctaaacaatattatgatatattatctgaagaacaaaagaaggaattaatcaaaagagttcaatttggtggcgatgaagttgttcaagccaagaatggtgctggttccgccactttatccatggcttatgccggttatagattagccgaatcaattttagctgctgttaatggtaaaactgatattgttgaatgtactttcttgaacttggattcttcaattaaaggtgcttctgaagctagaaaattggttaaagatttagatttcttttcattaccagttcaattaggtaaaaacggtattactgaagttaaatatgatatcttaaatcaaatttctgatgatgaaaagaaattgttagaagttgccattgaacaattacaaaagaatattgaaaaaggtgtttcatttgctaagaaataa

SEQ ID NO: 588 - protein, 337 aa, Candida albicans
MVKVAILGAAGGIGQPLSLLTKLNPNVDELALFDVVNVPGVGADLSHINSDSKTQSYLPKDKEDKTALAAALKGSDLVIIPAGVPRKPGMTRDDLFNINASIVQGLAEGIAANSPKAFVLVISNPVNSTVPIVAETLQAKGVYDPARLFGVTTLDIVRANTFISQLFLDQTKPSDFNINVVGGHSGETIVPLYSLGNSKQYYDILSEEQKKELIKRVQFGGDEVVQAKNGAGSATLSMAYAGYRLAESILAAVNGKTDIVECTFLNLDSSIKGASEARKLVKDLDFFSLPVQLGKNGITEVKYDILNQISDDEKKLLEVAIEQLQKNIEKGVSFAKK

SEQ ID NO: 589 - DNA, 621 bp, Candida albicans
atgggtatttctagagattcacgtcacaaaagatccgccactggtgccaaaagagcccaattcagaaagaagagaaagtttgaattaggtagacaaccagccaacaccaagattggtccaaaaagaattcactctgtcagaaccagaggtggtaaccaaaaattcagagctttgagagttgaaaccggtaacttctcttggggttccgaaggtgtttccagaaaaaccagaattgctggtgtcgtttaccatccatctaataacgaattggttagaaccaacaccttgaccaaatctgctgttgttcaaattgatgctactccattcagacaatggtacgaaaaccactacggtgctactttaggtaaaaagaagggtggtgctcatgctgctcacgctgctgaagttgccgatgccaagagatcaagaaaagtcgaaagaaaattggctgctagatctggtgctgctgccattgaatccgctgttgactctcaattcggttctggtagattatacgctgtcatttcttcaagaccaggtcaatctggtagatgtgatggttacatcttggaaggtgaagaattagccttctacttgagaagattaactgctaagaaataa

SEQ ID NO: 590 - protein, 206 aa, Candida albicans
MGISRDSRHKRSATGAKRAQFRKKRKFELGRQPANTKIGPKRIHSVRTRGGNQKFRALRVETGNFSWGSEGVSRKTRIAGVVYHPSNNELVRTNTLTKSAVVQIDATPFRQWYENHYGATLGKKKGGAHAAHAAEVADAKRSRKVERKLAARSGAAAIESAVDSQFGSGRLYAVISSRPGQSGRCDGYILEGEELAFYLRRLTAKK

SEQ ID NO: 591 - DNA, 318 bp, Candida albicans
atgtcaggtaccggtagaggaaaaggtggtaaaggtttaggaaaaggtggtgctaaacgtcacagaaaaattttaagagataacattcaaggtattacaaaaccagctatcagaagattggccagaagaggtggtgttaaacgtatttctgctttgatttatgaagaagtcagagttgtcttgaaacaatttttggaaaacgttatcagagatgctgttacttacactgaacatgctaaaagaaaaaccgtcacttcattggatgttgtttacgctttgaagagacaaggtagaaccttgtatggtttcggtggttaa

SEQ ID NO: 592 - protein, 105 aa, Candida albicans
MSGTGRGKGGKGLGKGGAKRHRKILRDNIQGITKPAIRRLARRGGVKRISALIYEEVRVVLKQFLENVIRDAVTYTEHAKRKTVTSLDVVYALKRQGRTLYGFGG

SEQ ID NO: 593 - DNA, 489 bp, Candida albicans
atggccggtgaataccggtttaaaaaacaaggggggaatctacagaattggggttccaaatgtcctaaaatcagaagagctgctcgtgaatttgtaaccagaggtgaaaaaggccccaaaaagattattcggaaggtaatggctttgatcagaagattagtcagattcggtttcttgtctgaggacaaaatgaaattggattatgtcttggcttggaacccagaagttttcttgaacagaagattccaaccccaagttttcaaattaggtttagctagatctatcccccacgccagagttttgatcacccaaagccacattgctgttggtaaacaaattgttaccatcccatcatttactgtcagattggactctcaaaaacacattgactttgcccacaactctccatacggtggtggtagagccggtagagttaagagaaagaaccaaggtaaaggtggtgaagaaggtgccgaagaagaagaataa

SEQ ID NO: 594 - protein, 162 aa, Candida albicans
MAGEYRFKKQGGNLQNWGSKCPKIRRAAREFVTRGEKGPKKIIRKVMALIRRLVRFGFLSEDKMKLDYVLAWNPEVFLNRRFQPQVFKLGLARSIPHARVLITQSHIAVGKQIVTIPSFTVRLDSQKHIDFAHNSPYGGGRAGRVKRKNQGKGGEEGAEEEE

SEQ ID NO: 595 - DNA, 330 bp, Candida albicans
atgccacacaaatactaccacggtaagactggtattgtttacaacgttaccaaatcctccgttggtgttatcattaacaaagttgttggaaacagatacattgaaaagagagttaacttgagagttgaacatgttaaacactctgcttgtcgtcaagaattcttgaacagagttaaatctaacgctgctaaaaagagagaagctaaagctaacggtgaaaccgtttacttgaagagacaagctgccaagccaagaggttcaagaattatctccactgaaggtaacattcctcaaactttggctccagtcgcttacgaaactttcatttaa

SEQ ID NO: 596 - protein, 109 aa, Candida albicans
MPHKYYHGKTGIVYNVTKSSVGVIINKVVGNRYIEKRVNLRVEHVKHSACRQEFLNRVKSNAAKKREAKANGETVYLKRQAAKPRGSRIISTEGNIPQTLAPVAYETFI

SEQ ID NO: 597 - DNA, 384 bp, Candida albicans
atgatagacaaaatgctgctgattcttgcctggggattcaatttgtggtatcaaccacctccacctactgcacaaactgagaaagaaatcgaacacactattaactctcacaagattgttatttattctaaaacttattgtccattttgtgaccaaaccaaacatctattaaatgaacaatatccacaagaatcgtacgaagtcataaacttgaatattctcgatgacggattgactattcagaatcaattgtatgctaatactggtcaatatatggtgcccataatcttcataaacggacaacacgttggaggaaattcagaagttcagcaattgcacaccaatgggaaattgcaagaattattgaatcctcagaaatattga

SEQ ID NO: 598 - protein, 127 aa, Candida albicans
MIDKMSSILAWGFNLWYQPPPPTAQTEKEIEHTINSHKIVIYSKTYCPFCDQTKHLLNEQYPQESYEVINLNILDDGLTIQNQLYANTGQYMVPIIFINGQHVGGNSEVQQLHTNGKLQELLNPQKY

SEQ ID NO: 599 - DNA, 486 bp, Candida albicans
atgttcagacaagttttccgtcaagttaccaaacaatcattcactggggttaagagaacttatgccaccgaggccgccgtgtctacagatgctttgaaattatccttggcattgccacaccaaaccttatacaacgactccgaagtccaacaagtaaacttgccatctgtcaacggtgatttgggtattttggccaaccacattccaattgtcgaacaattgagaccaggattgttagaaatcatttccaaaaacggagactctgaccaatactttgtcagcggcggtatcgccatggtccaaccaggaaacaagttgactatttccgccatcgaagcattcaagaccgaccaaattgatctctctgccgtcaaaaacttgattgccgatgcccaaaagagagctgaatctagtgatgaaaaggtcgctgctgaagccaacatcgaattggaagtgttagatgctttacaacattttactaagtaa

SEQ ID NO: 600 - protein, 161 aa, Candida albicans
MFRQVFRQVTKQSFTGVKRTYATEAAVSTDALKLSLALPHQTLYNDSEVQQVNLPSVNGDLGILANHIPIVEQLRPGLLEIISKNGDSDQYFVSGGIAMVQPGNKLTISAIEAFKTDQIDLSAVKNLIADAQKRAESSDEKVAAEANIELEVLDALQHFTK

SEQ ID NO: 601 - DNA, 795 bp, Candida albicans; identical to SEQ ID NO: 483

SEQ ID NO: 602 - protein, 264 aa, Candida albicans; identical to SEQ ID NO: 484

SEQ ID NO: 603 - DNA, 642 bp, Candida albicans
atgtctgaatctgagaaaatgtacatttcgtacaataatatacaccagttatgtcaagaaatagcccctaagatcaaagaatttaagcctgacttgatcattgctattggtggcggtggttttattccagctagaatgttgcgttccttcttgaaagaaccaggtcaaccaaacgttagaattatggctatcatattgtctttatacgaagagattgagagtgaaaacggtattgaaaagccaggtacccaagttgtgcgtactcaatggattgattatcatcaatctaaaattgacttggttggtaaaaatgtgttaattattgatgaggttgatgataccagaaccactttgcattacgcagtcagtgaattgaaaaaagatgtggaagagcaatcaaaagccaaaggtgcagatcctaaagataccaagtttggtatttttgtgttgcacgacaagcaaaagcaaaagaaagcagaattgccagatgatattatgaagactggtaattatttcgctgctcgttctgtcccagatagctggattgcatacccatgggagtctactgacattgtttatcatcaaatgaaagctgaagaacaaggaaacgatgtgttccttccttcatccactttagagtaa

SEQ ID NO: 604 - protein, 213 aa, Candida albicans
MSESEKMYISYNNIHQLCQEIAPKIKEFKPDLIIAIGGGGFIPARMLRSFLKEPGQPNVRIMAIILSLYEEIESENGIEKPGTQVVRTQWIDYHQSKIDLVGKNVLIIDEVDDTRTTLHYAVSELKKDVEEQSKAKGADPKDTKFGIFVLHDKQKQKKAELPDDIMKTGNYFAARSVPDSWIAYPWESTDIVYHQMKAEEQGNDVFLPSSTLE

SEQ ID NO: 605 - DNA, 498 bp, Candida albicans
atgcctccaaaatttgatccaaatgaagttaaattcctttacttaagagctgttggtggtgaagttggtgcttcatctgctttagctccaaagattggtccattaggtttatccccaaagaaagttggtgaagatattgccaaagccaccaaagaatacaaaggtattaaagttactgttcaattgagaattcaaaacagacaagctactgcttctgttgttccatccgcttcatctttagtcatcaccgctttgaaagaaccagtcagagacagaaagaaggaaaagaacgtcaaacactctggtaacattccattagatgaaatctttgaaattgccagaaaaatgcaacacaaatcattcggtaagaatttggcatctgtctccaaggaaatcttgggtactgctcaatctgttggttgtagagttgatggtaagaaccctcatgacatcattgacgccatcaacgctggtgaaattgatgttccagaaaactag

SEQ ID NO: 606 - protein, 165 aa, Candida albicans
MPPKFDPNEVKFLYLRAVGGEVGASSALAPKIGPLGLSPKKVGEDIAKATKEYKGIKVTVQLRIQNRQATASVVPSASSLVITALKEPVRDRKKEKNVKHSGNIPLDEIFEIARKMQHKSFGKNLASVSKEILGTAQSVGCRVDGKNPHDIIDAINAGEIDVPEN

SEQ ID NO: 607 - DNA, 360 bp, Candida albicans
atgtttcgtacattattaaccaaaagactattcaatacatcaacaatggtttcatctcaagttaagaacaaggtcgaacaattgatcaaaaccaaaccagttttcattgcctccaaatcctattgtccatactgtaaggctaccaaaagcacaattgaagctataacaaaggatgcttacattcttgaattagacgaagttgacgacggtgctgaaatccaagaagcattattggaaatcactggtcaaagaaccgttccaaatgtctttattggtggtcaacatattggtggcaattccgatgtgcaagctttgaagtctagtgacaaattagatgacaaaatcaaagctgctttataa

SEQ ID NO: 608 - protein, 119 aa, Candida albicans
MFRTLLTKRLFNTSTMVSSQVKNKVEQLIKTKPVFIASKSYCPYCKATKSTIEAITKDAYILELDEVDDGAEIQEALLEITGQRTVPNVFIGGQHIGGNSDVQALKSSDKLDDKIKAAL

SEQ ID NO: 609 - DNA, 972 bp, Candida albicans
atgcctgctactactcctattatttatgaagattctttatttgaatctcaagatttatttgcttctccagttaaacaacaacatcaaaaggttgatactgttgctaccaaaaacgaaattggtttggaattaaatttaggtttaccagaaatgcaaaaggcttcagaaactgtttccactccatttcaaatccattccagtgtattggagtcgggtttcagcaccaatttggatggagtcaatgatattgatcatactccaatgtttgatgaattggatttgattatggacggagccaaagtcaattcatcagaagattgggttgctctttttggagatgacaatgatgatggtgttgctatagctggtgctactagcaaagaaccaatgttatcattgaatgaagataacgagaacaatgatgacgacgctgatgacgctgatgatgatgatgatgctcttgttccaagagaagatactattgaagctttattattggaaccatcaccaaatcgtaccatttctgctgctacttctgcttctacttcatcattaaacagtccagaaagtactattgctaccacagtcactgctggtggtgaagttgttgttgcaagtaaaaagcaatttcaattggtaacaccaaatccttcatccactttaccaacaccattattggattctaaaaattctaaaaaaagagttaaagttgatcatttgggttgtgttacctattcgaaaaaacatagatctcaacctttacaaccgattgttgttgatgacattaaagatgctgctgctttgaaaagagctaaaaatactgaagctgctagaagatccagagctcgtaaaatggaaagaatgagtcaattggaagataaagttgagaatttgattaatgaaaagcaagctttacaagatcaagttgaaagattacaagaattgttaagagttaatggtattcaattttaa

SEQ ID NO: 610 - protein, 323 aa, Candida albicans
MPATTPIIYEDSLFESQDLFASPVKQQHQKVDTVATKNEIGLELNLGLPEMQKASETVSTPFQIHSSVLESGFSTNLDGVNDIDHTPMFDELDLIMDGAKVNSSEDWVALFGDDNDDGVAIAGATSKEPMLSLNEDNENNDDDADDADDDDDALVPREDTIEALLLEPSPNRTISAATSASTSSLNSPESTIATTVTAGGEVVVASKKQFQLVTPNPSSTLPTPLLDSKNSKKRVKVDHLGCVTYSKKHRSQPLQPIVVDDIKDAAALKRAKNTEAARRSRARKMERMSQLEDKVENLINEKQALQDQVERLQELLRVNGIQF

SEQ ID NO: 611 - DNA, 750 bp, Candida albicans
atgtcagctgaagccccaaaaagacaatttggtgatagaagaagaggtggtagaagaggtggtagaagagatggtgaagaaaaaggttggactccagtcaccaagttaggtagattagtcaaagctggtaaaatcaccagtgttgaacaaatctacttgcactctttgccagtcaaggaataccaaatcattgatttgttattgccagacttgaaagatgatgtcatgaagatcagatctgtccaaaaacaaaccagagctggtcaaagaaccagaatgaaggctgttgtcgtcattggtgactctaacggtcacgttggtttgggtatcaagaccgctaaagaagttgcttctgccattaaagctgctattgttattgccaaattatccatcatcccaatcagaagaggttactggggttctaacttgggtcaaccacactctttgccatgtaaagtcactggtaaatgtggttccgttgccgttagattaatcccagccccaagaggtaaaggtattgttgcttctccagttgtcaagagattaatgcaattggctggtgttgaagatgtctatacttcctcttctggttctaccagaactaccgaaaacaccttgaaagctgctttcgctgctatcggtaacacttacagtttcttgactccaaacttgtgggctgaaactccattagctgcttctccattggaagtttacgctgaagaagctgctgctggtaaaaagagatactaa

SEQ ID NO: 612 - protein, 249 aa, Candida albicans
MSAEAPKRQFGDRRRGGRRGGRRDGEEKGWTPVTKLGRLVKAGKITSVEQIYLHSLPVKEYQIIDLLLPDLKDDVMKIRSVQKQTRAGQRTRMKAVVVIGDSNGHVGLGIKTAKEVASAIKAAIVIAKLSIIPIRRGYWGSNLGQPHSLPCKVTGKCGSVAVRLIPAPRGKGIVASPVVKRLMQLAGVEDVYTSSSGSTRTTENTLKAAFAAIGNTYSFLTPNLWAETPLAASPLEVYAEEAAAGKKRY

SEQ ID NO: 613 - DNA, 312 bp, Candida albicans; identical to SEQ ID NO: 449

SEQ ID NO: 614 - protein, 103 aa, Candida albicans; identical to SEQ ID NO: 450

SEQ ID NO: 615 - DNA, 342 bp, Candida albicans
atgtcatctggtatccaatcattattgaaaaccgaaaaagaagctgcagaaattgttaatgaagctagaaaatatagaaccacacgtttgaagtctgcaaaacaagatgctcaagctgaaattgataactataaaaagcaaaaggaagaagaattaaaaaattttgaaaaagaacacgaagggttaaatgaaaagatcgataaagaagctgatgctgaagttgaaaaggaattgaccagtatcaaatccacttttgaaaagaaaaagagtgcagttgttaaattgttagttgacgctactgtcaagccaacaccaactttacacataaatgcatctcaataa

SEQ ID NO: 616 - protein, 113 aa, Candida albicans
MSSGIQSLLKTEKEAAEIVNEARKYRTTRLKSAKQDAQAEIDNYKKQKEEELKNFEKEHEGLNEKIDKEADAEVEKELTSIKSTFEKKKSAVVKLLVDATVKPTPTLHINASQ

SEQ ID NO: 617 - DNA, 1194 bp, Candida albicans; identical to SEQ ID NO: 581

SEQ ID NO: 618 - protein, 397 aa, Candida albicans; identical to SEQ ID NO: 582

SEQ ID NO: 619 - DNA, 1080 bp, Candida albicans
atggctcctccagcagttttaagtaaatccggtgttatctacggtaaagacgtcaaagacttgtttgactatgctcaagaaaaaggttttgccattccagctatcaatgtcacttcatcctcaactgttgttgctgctttagaagctgccagagacaacaaggctccaatcatcttgcaaacttctcaaggtggtgctgcctactttgccggtaaaggtgtcgacaacaaagatcaagctgcttccattgctggttcaattgctgccgctcactacattagagccattgctccaacttatggtatcccagttgttttacacactgatcactgtgccaaaaaattattgccatggtttgatggtatgttgaaagccgatgaagaattctttgctaagaccggtactccattgttctcatcccacatgttggatttatctgaagaaaccgatgacgaaaacattgctacttgtgccaaatatttcgaaagaatggctaaaatgggtcaatggttagaaatggaaattggtatcactggtggtgaagaagatggtgtcaacaacgaacacgttgaaaaagatgctttatacacttctccagaaactgttttcgctgtctacgaatctttacacaagatttctccaaacttttctattgctgctgcttttggtaacgtccacggtgtttacaaaccaggtaatgtgcaattgagaccagaaatcttgggtgaccaccaagtttacgctaagaaacaaattggtactgatgctaaacacccattatacttggttttccacggtggttctggttctactcaagaagaattcaacactgctatcaagaatggtgttgtcaaggtcaacttggacactgattgtcaatatgcttacttgactggtatcagagattacgtcaccaacaagattgaatacttgaaagcaccagttggtaacccagaaggtgctgacaaaccaaacaagaaatactttgacccaagagtctgggttagagaaggtgaaaagaccatgtccaagagaattgctgaagctttggatattttccacaccaaaggacaattgtaa

SEQ ID NO: 620 - protein, 359 aa, Candida albicans
MAPPAVLSKSGVIYGKDVKDLFDYAQEKGFAIPAINVTSSSTVVAALEAARDNKAPIILQTSQGGAAYFAGKGVDNKDQAASIAGSIAAAHYIRAIAPTYGIPVVLHTDHCAKKLLPWFDGMLKADEEFFAKTGTPLFSSHMLDLSEETDDENIATCAKYFERMAKMGQWLEMEIGITGGEEDGVNNEHVEKDALYTSPETVFAVYESLHKISPNFSIAAAFGNVHGVYKPGNVQLRPEILGDHQVYAKKQIGTDAKHPLYLVFHGGSGSTQEEFNTAIKNGVVKVNLDTDCQYAYLTGIRDYVTNKIEYLKAPVGNPEGADKPNKKYFDPRVWVREGEKTMSKRIAEALDIFHTKGQL

SEQ ID NO: 621 - DNA, 906 bp, Candida albicans
atgttgactcatcatttatcgaaattggctactccaaaattcttagtaccattcgctggtgccactgctttgtcaattggtttggcattgcaatattctacttccaacaattacattgctaacgaaactggtaaaactttcactgatagcaatgaatgggtggacttgaaattatctaagtcaattgatttgactcataacaccaaacacttggttttcaagttaaaagatgagaatgatgtttctggtttgatcactgcttcatgtttgttgaccaaatttgttacaccaaagggtaacaatgttattcgtccatatacccctgtctctgatgttaaccaatctggtgaaattgatttcgtgattaaaaaatacgacggaggtaaaatgtcaagtcacattttcgatttgaaagaaggtgaaaccttatcattcaaaggaccaattgttaaatggaaatgggaaccaaatcaattcaagtccattgctttgattggtggtggtactggtattactccattataccaattgttgcatcaaatcacttctaatccaaaggacaacaccaaagttaatttgatttacggtaacttgactccagaagatatcttgttaaagaaagaaatcgatgctattgcttctaaacacaaggaccaagttaaagttcattactttgttgacaaggcagatgaaaagaaatgggaaggtcaaattggtttcattactaaagaattcttacaaaaagaattagaaaaaccaggttctgatttcaaggtttttgtttgtggtccaccaggtttatacaaggctatatcaggtcctaaagtttccccaactgatcaaggtgaattgactggtgctttgaaagatttgggtttcgaaaaagaacatgtctttaaattttag

SEQ ID NO: 622 - protein, 301 aa, Candida albicans
MLTHHLSKLATPKFLVPFAGATALSIGLALQYSTSNNYIANETGKTFTDSNEWVDLKLSKSIDLTHNTKHLVFKLKDENDVSGLITASCLLTKFVTPKGNNVIRPYTPVSDVNQSGEIDFVIKKYDGGKMSSHIFDLKEGETLSFKGPIVKWKWEPNQFKSIALIGGGTGITPLYQLLHQITSNPKDNTKVNLIYGNLTPEDILLKKEIDAIASKHKDQVKVHYFVDKADEKKWEGQIGFITKEFLQKELEKPGSDFKVFVCGPPGLYKAISGPKVSPTDQGELTGALKDLGFEKEHVFKF

SEQ ID NO: 623 - DNA, 615 bp, Candida albicans
atgggtgcctacaaatatttagaagaattgcaaagaaagaagcaatctgatgttatgagattcttgtatcgtgtcagatgttgggaatacagacaaaagaatgtcatccacagagcttccagaccatctagaccagacaaggctagaagattaggttacaaagctaaacaaggtttcgttatctacagaatcagagttagaagaggtggtagaaagagaccagttccaaagggtgccacttacggtaaaccaaccaaccaaggggttaaccaattgaaataccaaaaatcattgagatctactgctgaagaaagagttggtcgtcgtgcttctaacttgagagtcttgaactcatactgggttaaccaagattccacctacaaatactttgaagttattttagtcgacccatctcacaaagctatcagaagagatgctagatacaactggatcgttaacccagttcacaaacacagagaagccagaggtttgacttctgctggtaagaaatccagaggtattaacaagggtcatttgttcaacaaaaccaaagctggtagaagacacacctggaagaagcacaacaccttatctttatggagatacagatcttaa

SEQ ID NO: 624 - protein, 204 aa, Candida albicans
MGAYKYLEELQRKKQSDVMRFLYRVRCWEYRQKNVIHRASRPSRPDKARRLGYKAKQGFVIYRIRVRRGGRKRPVPKGATYGKPTNQGVNQLKYQKSLRSTAEERVGRRASNLRVLNSYWVNQDSTYKYFEVILVDPSHKAIRRDARYNWIVNPVHKHREARGLTSAGKKSRGINKGHLFNKTKAGRRHTWKKHNTLSLWRYRS

SEQ ID NO: 625 - DNA, 318 bp, Candida albicans; identical to SEQ ID NO: 591

SEQ ID NO: 626 - protein, 105 aa, Candida albicans; identical to SEQ ID NO: 592

SEQ ID NO: 627 - DNA, 546 bp, Candida albicans; identical to SEQ ID NO: 457

SEQ ID NO: 628 - protein, 181 aa, Candida albicans; identical to SEQ ID NO: 458

SEQ ID NO: 629 - DNA, 603 bp, Candida albicans; identical to SEQ ID NO: 443

SEQ ID NO: 630 - protein, 200 aa, Candida albicans; identical to SEQ ID NO: 444

SEQ ID NO: 631 - DNA, 474 bp, Candida albicans
atgccagtcgatccagaaaaattagctaaattgcaaaagtcatctgccaaaaaagttggtggttcaagagttaaagccaagaagaacatcaagactgaacaagatgacaccaaattgattgaagctttgggtaaattgaaagctaccaaaatcgaaggtgttgaagaagccaatttcttcagagaagatggtaaagttttacatttcaacagagttggtgttcaaggtgctccagcttctaatacttttgccttcactggttacccacaagaaaagaatattactcaattgatcccacaaattttaccacaattgggtgctgaaaacttggaaatcttgagacaattggctgaacaaatccaagctggtaaaactccaaaagacttcaacactggttctgctaacgctgctgctgatgccggtggtgaagatattccagacttggttgaccaaaaatttgacgatgtagaataa

SEQ ID NO: 632 - protein, 157 aa, Candida albicans
MPVDPEKLAKLQKSSAKKVGGSRVKAKKNIKTEQDDTKLIEALGKLKATKIEGVEEANFFREDGKVLHFNRVGVQGAPASNTFAFTGYPQEKNITQLIPQILPQLGAENLEILRQLAEQIQAGKTPKDFNTGSANAAADAGGEDIPDLVDQKFDDVE

SEQ ID NO: 633 - DNA, 330 bp, Candida albicans; identical to SEQ ID NO: 595

SEQ ID NO: 634 - protein, 109 aa, Candida albicans; identical to SEQ ID NO: 596

SEQ ID NO: 635 - DNA, 279 bp, Candida albicans
atggctccaggtgaaagaaagaagtcctctagaaagaagaaggatccagatgctccaaaaagatccttatctgcttatatgtttttcgctaatgaaaacagagatattgttagagctgaaaacccaggtatctcttttggtcaagttggtaaattattaggtgaaaaatggaaggctttaaacagtgaagataaattaccttacgaaaacaaggctgaagctgataaaaagagatatgaaaaagaaaaggctgaatacgctaaaaagaattccgcctaa

SEQ ID NO: 636 - protein, 92 aa, Candida albicans
MAPGERKKSSRKKKDPDAPKRSLSAYMFFANENRDIVRAENPGISFGQVGKLLGEKWKALNSEDKLPYENKAEADKKRYEKEKAEYAKKNSA

SEQ ID NO: 637 - DNA, 396 bp, Candida albicans
atggctacttctgttccacacccaaaaattgttaagaaatacaccaagaaattcaagagacaccattctgacagatatcacagagtcgctgaaaactggagaaaacaaaaaggtattgattcatgtgttagaagaagattcagaggtaccatcccacaaccaaacattggttacggttccaacaaaaagaccaagttcttgaacccagctggttacaaagtttacttggttaaaaacgttaaagacttagatgtcttgttattgcacactaaatcttatgctgctgaaattgcctcttctgtctcatctagaaaaagagttgaaatcgttgctaaagctaagaaactcggtgttaaagtcactaatccaaagggtaaattgaacttggaagcttaa

SEQ ID NO: 638 - protein, 131 aa, Candida albicans
MATSVPHPKIVKKYTKKFKRHHSDRYHRVAENWRKQKGIDSCVRRRFRGTIPQPNIGYGSNKKTKFLNPAGYKVYLVKNVKDLDVLLLHTKSYAAEIASSVSSRKRVEIVAKAKKLGVKVTNPKGKLNLEA

SEQ ID NO: 639 - DNA, 2791 bp, Candida albicans
tatccattggtaatgaatcagttaataccactaccaaaactgttttattaaaatctagagcagattttaatactgtgattattgaatttgttgataacagagtcgtggaattggattctacccttgattgtaaagaaattgtcaaattccctcaattatgtcgtgatattgaagtttcttttaaagaagatactcaacaatatgaagcttttgggatttctcgaaatgggaaattattttgtaatgaaaaccatgttgttagtggtgtcacatcattaaaaattactgaatctcatttattattcactaccgtacaatcaaaattatgttttattcatttaaattcaagtcaagaaaattatgaaatttttctgaatttaaccaatgaaaatattgttgatgaaagaattagacaagtggaaagaggatctatattaatcaatgtaatgccaacgaaatattctgtagttttggaagcccctagaggtaatttggaaactatatgtccaagaataatggtattatcagccattagaaaattcattaaacaaaaaaattataaagatgcattcattacttgtcgtacacatagaattgatttagatattttacatgattatgaaccggaattatttttcaataatgtggaaacatttattaatcaaatatctaaagtggaatacttggatttatttgtttcttgtttacatgaagaagatgcaaccgttactaaatatagagaaacaataaatgatgctgctgctgctgctggtggtggtattaccaaagaagaagaaatcaaacgtgaaggtgaaactcttcaaccagcattcaggaagaaattccatcacataaaggaaaaagttttcaccaatttcaatgattccaaagttaatcgaatttgtgaagccatattaaatgtattattaaaaccagaatattttgataaatatttacaaacgattcttactgcttatgcttgtgagaaaccagcaaatttgactcaagcactcacattaattggtaaaatggataatcaagaacaaagagaaactgcagtgactcatttatgtttcttacaagatgtaaataaattatataaaacatgtttgggactatatgatgtcaaattaactttagtcattgctcaacaatcacaaatggatcctaaagaatatttaccatttttacaaaatttgcatgtacaaccagaattgaaaagaaaatttttaatcgatgattatttgaaaaattatgaattagctttgaaatggttacatgaacaaggtgatgaagctcatgaagaatttgatgattatgttgtattacatgaattatacaaaccagctttgaaaatttatacctatgataaacccagaacaaatgtaatcatgggattgtttgctgaacatttacgtgaaactaaacaatttggtgaagctggtgtgatatttgaatatttgattgatttggaaaatgcattagaatgttatataatggccaagaaatggaaacaagcattatcattagttgagaaaagtgctgaccttttggagaaattatctgatacggctgaaaaattagttgaaacattaactgaagatcataaatatagtgatgctgctgaaattgaatatcaatttttggggaatgttgaagcatctatcaaattatattgtaaacaatattggtatgatcatgctatattattagctgaaaaatctaaaaaaccagaattgattgaatcaatagttgatgttcaaataaatgaagggtttggggtgattgctgaattattagccgattgtaaagggcaaatgaattcacaattgaaaagacttcgagaattaagaactaaaaagcaagaagatccattttcgttttatggaactcctgatgatttagatactcctgataatgtatcggttgctgcttctgaaacatcaaccaccccatcatttttcacaagatatactggtaaaactgctggtacggccaaaacaggagcatctagaagaactgccaaaaacaaaaagagagaagaaagaaaacgtgccaagggaagaaaaggtactatttatgaagaagagtatcttattaaatcagttggtcgtttattagaaagattagatcaaacccaatcagatgcgcttaaattaattgaaggacttttaagaagacatatgaaagaacaagcttatcaaatacaaaagaattggtgtgaattgattgattttatcaaagaaaatatcgatgaaattcataatatgagtgaaaaagatcgtgaaagaatcgatgataatggtgaaatctatttgattgatgaaattccaaaacctaaagtatcagaattccctaaattcaatatattagattattaatcatggaaataagctaagataacttttatttataaatagaaccacagaatcatcttactccttgtatagactatatttatttatttatttatttatttatatatcatattcaggagcaaattgtttcatcaattgttcttgttcatattcaagataaagatcacgtaaccccacaatggcattttttatagcatcagtaactgctttctttcgagcactagcataacacatatgtttataaggcatatttgtagattctgcttgtcccagttgttctctaaaagtaccatctttcaatattaatcgtattttcactacaacaagggcagaatacttgttttcatcttttattttcccgtttgggttaaaattaccaatcccaaaaattgtcggggtgaccattccatcca

SEQ ID NO: 640 - protein, 67 aa, Candida albicans
ENKYSALVVVKIRLILKDGTFREQSGQAESTNMPYKHMCYASARKKAVTDAIKNAIVGLRDLYLEYE

SEQ ID NO: 641 - DNA, 24076 bp, Candida albicans
acactactactggtcgttggtcgttttctggcaatgccccggaaaaaccttaaaactgttatttggtccattgccgtcaagcaaccaaaaataacaatggcggtcccggaagatgcagcgtaccaagaaaagaggggataaccgatgtgtttgtcaccactaagccatctagcaagtctatgagctcaaatcaacacagaagagaaaatcaaatccacacatgcttggtagcactaggcgaattagagttttcagttttcattcttattgttaagtgttgattgagcaacataaaaagccttgtccactttctcgaggcagttaccggaatattacgtattctcctccttctcccctattttctaaaccaacaaacaaaaaataaatatcatgagaagttaaagaaaataaatcgctcaaagtttatctacgcaaaactatgctaaaacaacaaaccacaaaaaaaaaaaaaagaaattgtcgacagccgtaatagagtctagaccatctgctcattacccgaatgagctggtcagtatctttcaaaattattggttaaccaacaataccgtcaactcaagtcctaacctcttcttgccaacccctctagcaccccaaggaacaatcgaatgtttcttccttctctcttgaaacattcttaataatacgtatgtaattatttgctgacttcttttttttttgtttttttcttattttttagaacttccgtttccccgctcctactaaaatcttcccgggttgaacggtaagtctcggaatacacttcctaataattcctatacaccaattctaccccagattttttggaggttgcgcgtaacctattcatatgcccccgggacaagggaagcaatcttaaaaagaaaaaaaattttccagcaaaattcgttgatacaagtctttattaatggtctgataaattagtataaaaccaccatcaaattcccttgaaaacttgattgatttttttctttctttcttcgaatcaatcattaacttattcaaataattatcaatcatggctcctcctactgctgttgaatcttcaatcaatttcggaggtcacccaactatcaaatccactcaagacccattggtccaaaagttgtctcttaataccgacactgtgatcagacacaatgctccacctccaaccttatacgaagatggtttattagaaaaaggtactactatctcatctactggtgctttaatggcttactctggtaacaaaaccggtagatctcctaaagacaagagaattgtcgacgaatccacctcatcccataacatttggtggggtccagtgaataaacaagttgacgaattaacttggaagatttctagatcaagagctttggattacttgagaactagagaaaagttgtttgttgttgacgcttatgctggttgggatccaagatacagaatcaaggtcagaattatctgtgctagagcttaccatgctttgttcatgaccaatatgttgatcagaccaactgaagaagaattaaaaaactttggtgaaccagatttcaccatctacaatgctggtcaattcccagccaacatccacactaaaggtatgacttctgccacttctgttgaaatcaactttaaagatatggaaatggttatcttgggtactgaatatgctggtgaaatgaagaaaggtatctttactgttatgttctacttgatgccaatcaaacacaaggttttgactttgcactcctcatgtaaccaaggggttgaaaaaggtgatgtcactttgttctttggtctttctggtactggtaagaccactttgtctgctgatccacaaagaaagttgattggtgatgacgaacattgttggtccgacaatggtgtgttcaacattgaaggtggttgttacgccaaatgtttggacttgtctgctgaaaaagaaccagaaattttcaactccatcaagtttggtgctattttggaaaatgttgtctacgacccaatcaccaaggttgttgactacgaagattcatcaatcactgaaaacactagatgtgcatacccaattgatttcattccatctgccaagattccatgtttggccgacacccatccaaccaatattatcttgttaacatgtgatgcttccggtgtgttgccaccagtctccaaattgactaatgctcaagttatgtatcatttcatttctggttacacctccaagatggcaggtactgaagaaggtgttactgaaccacaagctacattctccgcatgtttcggtcaaccattcttggtgttgcacccaatgaaatatgctcaacaattgtctgacaagatttccgaacacaatgccaacgcttggttgttgaacactggttgggttggttcttctgttgctcaaggtggtaagagatgtccattgaaatacaccagagctatcttggatgctatccactctggtgaattgtctaaagtcgaatacgaaaaagttccagttttcaaccttaatgttccaacttcttgtcctggtgttccaagtgaaattttgaacccaactaaagcttggacccaaggtactgattcattcaacaaggaaatcaaatctcttgctaccaagtttgctgaaaacttcaagacatacgctgatcaagctactgctgaagttaaagctgctggtccagaagcataaacaaacaaataaacaaaaaaaaaaaagatcaagacatgtcagttatgttttttatatagttccatacatttcatattcatatatatatttatttttcaatggttttttcaaaaaaaaagttgagagttttgaatgtagaagtgtcaacctgtggtgcacatacgaaaaaacacccagaataactgaactctatagttagcgcctcatgattaaaaaaggggacaatcaaagccacaacgtgtcaatctagacattatctctattaccatactcataactcaaaatctcaatttcccatgtgcatagccatttaattacgagtttagagataacaaactttcacaggggcttggtgatgttatgttctattgtttggagcggatattcctgtagcaaaacaatgaagagtctaattgcataaccttaattggatgcattgattcagagaagaatgataaggcactgtttcattgataagattaggtctcataatcctatggggcgttgagcttgtgataatttttccttttttgacagaaaattaagttggttatgagttggtactacctggcctgtgatattcacttaatagcagcatacaagcattgtcaacgacatagtactgtgtatgacagaacattttgtgtgactagagcttgcagaatgtagagatggatggatgctgcaaagagcggctgcggatagtaagcaatagttgtgttcagatattttatttgcagttgttatctccgccaagtgatgatataatttccactaaccgcaatacaaagaacggagaaaagacaaaaaaagtacacaaaagcttaaccaggcgatggaaaaaattaaaatctttacaatttttttttccttaattgtttgaaaaactccgcatttgcacatgcactactgaactagacatttggattattatttataaccaatgtaatatcccaccttccatcaatatgaaaagttgcaatatcaaattcaaattcagaatagcaatccatatttatttattatcatgagtgtttcagacattgtccaagaatatatcaccaaatggtatgtcgttatacctactttgtttgttgtctatcaggttgttgatttcttctatgttagaagcttaagaagtcgtcttggtgccaaagctcctacaaacaacgaatccgatggttattgggggttccatttaccattcttgttggtttccaaaaaagctgaaggtacaattattgatttcgctggtgaacgtttcaaaagtattgcccacccagaagtcccaacttttcagttcccaattttcactgtcaaagttatttccaccgttgatccagaaaacattaaagctgtattggccacccagttcaatgacttttcattaggtactagacacaatcaatttgctccattgttgggtgatggtattttcacattagacggtgctggttggaaacatagtagatctatgttgagaccacaatttgccagagaacaagttgctcacgtcaaggcattagagcctcacatgcaagtattattcaaacatatcagaaagagtggtggtagaacttttgatctccaagaattgtttttcagatttactgttgattctgctactgagtttttatttggtgaatccgtcgagtctttgagagacgaaagtattggtatggctttagaagcagtcgattttgatggaaaaaaggaatttgctgaagccttcaacttttctcaaaactatttggcctcccgtgctgttatgcaacaaatgtactggttattgaacagcagtgagttcaaaagttgtaactccaaggtccacaaatttgctgaatactatgtcaacaaggcattggagttgtctcatgaagaattggaaaagcaacaaggttatgtctttttgtatgaattggcaaaacaaactagagacaccaaagtgttgagagaccaattgttgaacattttggttgctggtagagataccactgctggattattgtcgtttgtgtttttcgaattagctagaaatccaagagtgtttgccaaattgagagaagaggttgaagaaaagtttggtgttggtgaagatgctcgtgttgaagaaattagttttgaatcattgaaactgtgtgagtacttgaaggctgttcttaatgaatgtttaagattgtacccatcggtcccacaaaactttagagttgctacaaagaatactaccttgccaagaggtggtggttctgatggtatgtctccaattttggtcagaaaaggtcaaactgttatgtacagtgtttacgttacccacagagacactaaggtttacggtaaggatgctgacgaattcagaccagagagatggtttgaaccagaaaccagaaaattgggttggtcgtttgttccattcaacggtggtccaagaatctgtttgggtcaacaattcgccttaactgaagcttcttatgttactgtcagattacttcaagaatttggtcatttgactatggacccaaatactgattatccaccaaaaaagatgtcacatttgaccatgtctctttacgatggtactaatgttgaaatgtattaagcagggctagatttatatagggtatataggtattttaagaaggataattgtttgcaaaaaaagtgctgtagattttcacatgactgagggtctttgtgttgtatgtagaacaaaacctatatgcagaacaatagggattgccatttccttgtttttgatttgacaactttgtatgcgcccttttgttgttgggcatacatatatattttgcgactagcatgtgatagaccagcagaatacactactatcgaatcagttaaagtagatctagaaataaactcaatgataatcgtggcactattattagagtttaactttttgcggaaattctaagttctaccaagaaatcctttgactgatcttgatgctccaatttatttttttttaattatagcatcgtctcgtattcccaagcttctagtgtattattttgattatatcgacaaactgacaatgcatagaggtgcatgtgaaccagctctattgtctggctaacttcttggtgtgggacatgtaatcgagaatttcagattacacacagagaggggtaaatttagctttgttttaggatcgtcgcaattgatggagaacaataaccattacaactccgcaacactccgagaagtataccagtattcgttattcatacggagtacatgtgaaaaagaagggaggcactaaaattatgaacatttccattgttcagcataaaaggaacgttcgtgtacttgtgcaaaagaaagcaccaaacctccttactattcgtaacacattttctatattgaggggttattgtaatgatactttgacaatcactttaaacagcaaaacaattgccatgtgaagaaagagtacaaatatatatatgtttgataggatcctgctagctacaatgtttcatttttacagaataaccaaacaaaatgtccccctcgcttgttcaccaaattcttgctatcactcatccatatgttgaatatttggaagaaaacattactaaatggtatatcctagtaccaggtattcttattgtgttaaatgtgttaacaactcttcatacaaagtatttggaatacaaatttaatgcaaagcctgtcacaaacttcattcaggattacacttttggtgtcataactccattgattttgatctactacaagtctcaaggtacagtaatggaattcgccaataatttttggaacttcaaatttctcatcaaaaacccagatgtaggaacaggtgagcttagaatatttggtatgcatttaattgaaaccaaggacccggagaatatcaaggcggtattggctacccaatttaacgatttctctttgggcactcgtcatggctttttgtactcattgttaggtgatggtatttttacattggacggtgctggctggaaacatagtagatctatgttgagaccacaatttgctagagaacaaatcgctcatgtcaaaatcttggaaccacatatgcaagtgtttttcaaacacattagaaagaacaaggggaaaacatttgacatccaggagttattttttagattgacagttgattcttctacagaatttttgtttggtagttcagttgagtctttgagagatgaaaccatcggcatgtcacctagtgtgaagaatcttgctggccgagatgaatttgctgatgcatttaattattcacaaactatcaatgcctacagattcttgttgcaacaattttattggttgtgcaatgggactaagtttagaaagtcaattgctgctgtgcacaagttttctgatttttatgttcaaaaggctttgagtttaagccaagatgaattagatgaacaaaaagggtatgttttcttgtatgagttagccaaacaaacccgtgatccaaaagtgttaagagatcagttattgaacattttagtggctggaagagacacaactgctggtttgttgtcatttgtgttttttgaattggccagaaacccagaagtatatgccaagttgaaagaagaaatctacaataagttcgggtccggcgaggatgctcgtattgatgaaatcacatttgagtctttaaaacaatgtgaatacttgaaagctgttatcaacgagagtttgagattgtacccatcagtgccacacaattttagaactgctactagaaataccactttaccaagaggtggtggtccagacggtatgtcacctatagttgttaaaaagggtcaatcagttatgtacacagttttggtaacacacagagataccaaaacttatggagtgacgctaacgaatttagaccagaaagatggtttgaaccagaaactagaaaattgggatgggcttatgtcccattcaacggtggtccaagaatttgtttaggtcaacagtttgctttgactgaagcttcttacgttactgttagattacttcaagagtttgagcatttgactatggatgcagaaactcgctaccctcctaaattaatgaatagtttgactctttccctcttagatggggcaaatgttgaaatgtattaagcgcaagtagtttatgtatgtataaaacattcgaaataaaaaaaaatgtcgccttttacttgagtcgctcgattgtgcgaagcaaaaaaaaaagaaaaatttgtaaacatttttctttcaactcatccgtcattctttatttacatcccactcaaccaacgacaacgaacaagaatgagtggcatatttaattggtcgctggatgtgtttgccgatatttataacaccctcaagtttgagtccaatatagatttggatacaatcgacttcaccagcatcaagaatgatcttgcaaatgttttgattacaccagtccctctggatcaatcacgtagcaaacttggagacgcatcaaaaccagtggcgttgcccagtggagatgaggtgaaattgaatcaagcatcaattgaaattactggagttttatcaaatgaattggatttagatgaactaaatacagcagagttgttatataacgcaagtgacttgagctacaagaagggaacgtccattggcgatagtgctcgattggcttattatttaagagctcattatatactaaacattgttggatacttagtttcgcataaacgtttagatatcatcactaacaacaaccaagtgttgtttgacaatattttgaaaagtttcagcaagatttatactttgagtggtaaattaaatgacatgattgacaagcaaaaagttaccggcgacatcaacaatcttgcatttatcaattgtatcaattattccagaagtcagttgtttaatgcacacgagttattgggacaagttgtatttggattagcggataattattatgagagttatggcacactaaacaactataaatccttagtggagtttatactgaaaaatatcagcgatgaagatgtttttgttatccattttttaccatccactttacaattgttcaagaaattacttcaactaggtgaggaatctttagtcgatcagttttacaagactataacctcttccatactaaaagattatgaagccaacaatttttccaaaagtgaagatattgacttgtcaaaatcaaaattgtctggctttgaaatagtcacaagctttatttttctaactgagtttattccatggtgcaagcagctgtcaagtagaaccgcgaaatacgatttcaaagatgatatattaaagtatatggaattcttgataagttatggagttatggaacgattattatcgtactgttctgaaaccgccaatgcaaaaactcagcaagtgtacgactggtcaaacatgtacgatttcagagcattgcttcaaaagaatttcccacgacttacaccagcaaaatttcattatcctggcaatcaagaattgttgaatgcagttagaccgggatatgaaaatgtatccaaattgattgacatttcctttttgacgttagatccatcgcttaatgagacgttggtttcaccttttttccagagctttttcagtgtgtttatatctaatgcggcagttgttatgacctctttaagggactcagaggaagattttgttttatcgtcgttgaatgaaagtgacgaagaggaagaagaagaagaaagcgacagcgacgaagattcttcgaccccaaaaaacaaagaaaaatcaactgggttagaccttgacaagattgcccagcgcgctgaattagaaaggttctacttggctttcgcgtacacctacaacaatagacctgaattgtgtgcgttattttgggggaacgagcaggtaactcatgacattataggatttatttcctggggacttgctaataatacgtctccgttgatcactgcaacattctgcttactattagggtcgttggcatctgctggtgcagaggcaacttcaaggatatgggagattcttgtacacaacaataacaacgcaagtacgagaaaaaatgatttttcaaagatatccgttgactccctttatgattcgttgaaatattacattgactctttaaatgaaagctttgaacaagatttaaatgcccaattgatgttgaatcagaagaaacaagattttctcttcagcaccacaacaagcaaacaggaccttgatgattctggcgagaatagaattgttatagagttggccgaggattcacttgtcttcatttcagggtttattcaattactttctgcaattgtgaagaatttgaacactaagaatgaaagaagcaaagaaatcaaatccgtggtatacactagattctcaccaatcattaaagggtttttaaaattcgataatttgatcaatggtagcaggttccttcaagttgatgctagcattcaaagcacaaacaaccccaaatttattgatttgccaaatgttttcgtcagtgatgactcgagaattatattgacgaacctcattctaacctttttaggcgattttgttaccaacgatagtgatccgtatattagatatgagatttggcgtttagtcgatcgatggatgtaccaggggttgcatagtttgccagaagataagaaagatgatgcttttagacatattaagagaaagtatatcagtaagaaaaatgtccccatcaatcaagcattttcaacaaacctaactcatcttagtcagattgggaatttcactgtcttggtgaaaaaattgttaaccccatacgcagatagtaatgaagcattcaccaagtactcgttgttgtatccttgtgatttaggatcagggtatagattcaacaaccaacttggaatttggccatacattgaatttttaatgcaaaatgtgtttgcaaactctgctactattgctaataaacgagatagggtcaacttgcaacttaatttgctagaattatttagcaatgcattacaggaagttgactggaagtttcttattgatgtggcaccgaaaattattcgtgacttgaaaaattttaatgggatatttgactcgcttattcctggtgttcaattggactttgaagtgtttgtcaaattgcatcattcagttgctgtgattaactatctatttgaaaacaagacattttctgctttgtttaagcttgttaatattggagttgattctgtgaatgaatcaggtgaatcggctgcattagtgtcacatgcccttgggttgattaattctttgttgagagttcaaaattcttttataaacaagttgttaccaatattgcgaaacaaagatacgcagcaacaattacattgtgggacagccattgggattggtacttctatgagtctttcgttagcaacccctagaaccatatttgattgtatatactatccaaagaacttgggaacacatggtgttgctgatttctacgaagtgatattgttccacttatctgcagttgtccaatttgccctttatgtcagttgtgaaaatactatttccaacaaagcaatttccatattgaaaggagtaagccaatcgaaattttttgttaccagagtttcaagctctgctgatcccttactcaacaacgatagattgattaccacatttgaaaacatcgacgagtcaataaaaatcaagtttgctttcattgacaagtttgaagaactcgaggactctttgaatatgaaatatgagatattggattttgttttgggcaatctcaatcaatttgatggcaaagtggctactactgcccactttttgttgggatacaaagtgaaaggcgatacattagacttggtacagacaaacgatcaaaacacattactaaaatctttcttaaatacattgagcattagtcttgatttaatttctgaaattgattacaataatggtaataaccatattattgatgttggtccagccaagctttcgtcgttgattttacagattcttatcaagttgtgccaagatccaatttcgtcgtcaataacattgaatcaattacgtgaatatgaagaattgtttgaaaaattggttaactgtcaacctaaacttgatttgaataccgtttggtgtggtaaccagtttgatggggatttgcagattgatgctagcaatgtatttgttgacaaccaagcaagcacccaggctttcttttcctttattaaccagagaaacttaattttgcagtatttgtcattggaattccatagtgtcaaatcaagaactaagcgggagtattattctaaagtgttgaccaacgacaaggaatttgttaatcgtacacctaaggtgttgacatttttaaacattctaaattattcattcaagaactttgaagtgcagaaatacgaatggcttgaccaaaaatttaacatgtcgttgttattggcagaagtaaacgctcaaaagaatggtacattagatttttctgttttaacaaaggttttccgtcttttgtgccaaacgtcaaacttaataacacccgagtcaaagcaattgtttgccgaagaaattatggttgaaggaagtaagatttctgactttgtcacaaagtacctggtgtcgaccgacttgaaggatgtgcagttgaaatgcttacattcatggtgtcaattgatagagattttggttactgacagtggaatcaattcgctgaatttcatcttggaagtgttgcaagttattattcccaaaatcaatgactattttgatgtggacatactgttttctgaagaaatggtttcattatgtgttttattgtttgatctttatgatcagctgactcttgcggacagaaaaggtgaagattttgcacttggaattgagagattgatccccttatttcagacttgtattgcaggtattcttaattctaactcaacacccagcttacgctcagacttgtatgtagttggcaacaagtttttgttaaaatgttttgagagagagtcgtttttgaaacaagtgatgcatatcatcaagtcggtagataaaaagtttttccaggtgatttgtaatgacgctatctactcagagggtccatctagaatcacttctactttattcctcgagtcattagttcacttagggactttggtcaaggttgattttattttgaatgcgttgatcaaaaataacgcattgctgttgctagtcaggtcagttaagcggactgatgccatgatcaaattgtgccaggaaaaaaattcaggagtgactttagatcatttcatatttgacttgatggcattcaaagcaacgctatatttttttgttagagtggccaaatcgaaaaacggggcattgcagttgattcaaaatgaattgttttcaattttgcatcagtcgaagtttttgcagattgatccagatattggtttaagtttacgaattgaagaagttcaagatcacaagactgtcaatgtaaatgttttgctagatactccactttcgataactgacttggtggatccatacaagttgcgaagtgaaaacactatatcatattttgagttccttgtaccaatatttcagctacttacaacagtgttattgtcaatgggaccaaattatcaacctgcaattattcaaactagagaacttatgaagagtgtaaatcgattggtggtaggtgttatgaaaagagatttcttggtagagaccaaacaaattggtcaagggttgtacaaggaagagagtcacgagttggtatcgttgaaagaattggtgaagttgtttattttgattgattcattagctcattatagtgtgtagttgtggtagtgacacgaccaaatatattttgttcttggaaaaaaaaaatatttcgccttctccgaagattacagcaaaccatatccataaccaatcaagtatggccgacaatacagaatttgaaaagacagatccatcaaagtttttgagtggaataatagggtcttctgtgagtgtaaagttacacaatggtgttgaatataaaggaaatttgcagacaattgatgggtttatgaatgtggtattagatgaaggtaaagaaactgtcaatgggaaagtgactaaaaaatatggagatgtgtttattagagggaataatggtatgtataaggaaaactattgggatataaatagcgttttactaacatttcgtttctagtgttatatataagtgaagcttgaagtaggttgtataattaaatgtattttagtgatgtcaaatgctaatgtctgtaggaattgagcgcagattggacgaatcatatgtcgtcgtgtagtccgtgcgaaaaactttttctgtttcaacccacacaacaaacaaccagaaaaaaggaagaagaaaaaatctatcaatcaaaaaagtatttcactttcctacaaccaacacagtaactattccaaagatgtcattcgtgattagaagacaattgtccactttgattcctccaaagatcgcatcagcaaaagtatgttaggactgctagaagtgtgttgaattaggattgatttactaacgttatcattatagaaccttggatccaacccaaatgccaaaagaatggctgaagttgtcaagttctacaacaagttaccacaaggaccagctccagctgcaaagaaatccaacaatccattcgccagatacagagctgcttactttgatggcgataatgcttctggtaaaccattagtccacttggctattgccgttgttatctttggttactccttggaataccaacacttgaaacatgctcaacatgaaggtcattagttaatgttcatagattaaaagaatgtataaaaaatttgaagtgatatttagtcttgtgtgggcgaagggtacacgaccattgtagtgggagatagttctgttgagaccaagaatggaaacgcatacgacagaacgagaaaacaatgatcgaccacaccgcctccaatcaaacaacagaggcaaagtaggcgtttcttataaagaattgtagttcttttaagtgtagttgtagacagtattcataaaccaggtgcgagcaatctgaaacttccagtagtagtggtggtgagagagagagagaccccttaaacaaaaaaaaagtaatcttaccaagctggcttgctcaagactcatttcgggaaagaaaaaaatatccaacatttttttttccaaattagacgacaacaacacaggtaattgataacattatcatcaatcatcgaaggctcacgttatagttgctttgattgggtctgatttttttttttttttctaatccacctaaaacaaagagctaaacgcactgactaaaacgaataaactaatcttggacattccatttataatcaattatgaacaatcaagacccagattcacaataccataataaaaaggtgtatccaccaaatctaccatcaattccacctccaccgcaacaacctttgagtggaagacctgcaacaccaagaatgttacgtagtataagtggcacactaaagtctaaaacagaacttgctcactctgacaagggtcaggaatcgaacaatgaaaccaaaaatagcaattcccctcactatgtacctgatacacataccagacaaccaccaccagaatcactcaaatcaaatattcaagctccaacagctgttcatgggaatcagcaaaaaggactgttgttgccaccaccatctattccgaatccaaacactatgaaacctgcgccaacaccaactggagtcgaccaaccacctgcaaaacaaaaaccactgccagcacctaaacaaccacaaccacagcaacagcagcaacaacaacagcagcagcaatttcatagaaaatctattggtgattggaatttcgtaaagactatcggtgctgggtcaatgggtaaagtgaagttggcacaacataatgccacacatgaaatttgtgccgttaaaattattcctagggcagctaaactttatcaaagagcacatgccaacgaccctcctccgcaaaccacacaagaagcagctcagagacataaagagtttgaaaaagaagttgcgagagacagaagaactatacgtgaaggggcattggggagattattgtatcatcctttcatttgtcgtttgtatgagatggtacctatgacaaaccattattatatgttatttgagtatattgaaggaggacaaatgttagattatattgttgctcatggatcgttaaaagaacgacacgctaggaaatttgccaggggcattgcatcagctttagattattgtcatcgaaacaatgttgttcatcgtgatttgaaaattgaaaacattatgataaacgaaaaaggtgacataaagattattgattttgggttgtctaatttgtatgcacccaaaaacttgttaaaaacgtattgtggttcgttatattttgctgcaccagaactattgagcgccaagccgtatattgggccagaagttgatgtgtggtcttttggggttgtgctttacgttttggtgtgtggaaaagtaccttttgacgatcagtcggtttcggttttacatgaaaagattaaaaagggaaatgttgagtatcctgcttttctttccagagaatgtgtgtcattgctttcaagaatgttggttgttgaccccactaagagagcatctttgtacgaagtttgtctgcatccatggatgaacaaaggatatgattataaggtgaacaattatcttcctagaagagaacctttgcgtttaccgttagatccggaaataatcaaaaccattgcaaattttgagctaggcacggtgcaaggtgtcgctgatgagttgacgagtattttaacgagtgttgaatatcaaatgagttgtgaaaactggtacaaaattactgaaacaggaagagagtatgcgtcttctcagaatgcacaaatattacctgatccaactggcgggttccatcctttggtatctatttactatttggttgacgaaatgagaaagaggaaaaaggcaaaggaagaggcattaaaggctcaaagacgtgctcaagttccgacaatcgctgttcctacaccaaaacaacaacaacaacaacagccacaaccagcacagccacaaccacaaccacaaccagaagtatctcagccattgccagaaccaaaacctgtaccccctgaggagataatcaaccctgcagtggcaacacaggcacaagctaacatgacagcaccaaaaattgtggaaacattttcagagacccctcaaagaacattggacccatccaagcaatcagtggatgaaaaaccaagtgcaccaggtccatctattgctgttccagaacaagcacacaccacatctgtcccatcatcgtttgttaaaacacagacatcgattgatgaagatcaactttccattcctgaacaacaaagtccaagaacctctaccccacaaactttggatcctgcaaaggtggttggcggctcatctggatctgctatatcagcccctaatgctggtagtggtgctggcttcaattctttgttaagaagattgtcttcgaaaaaatacaagggggccagttctcctaaacgttcaacatctccactgccaaatgttgaagggctctcgccacaaccaactaaggccgacccaatggtacgtcgtggtgttagtatgaaggttactgctaaagagaaacaaacgaatacaagaccaccaaagtcagagttaatcaaaaagaaaccgcaacatggtcgttcttcctccacttcaaacaaaatgcaaggatccattcctgttgagtatttgccaccattaccaaccattgataccaataccaacacgattgtttcagacggtgctaaacaacaaaatttgactgtgccttctacagcacgtcatatgcaccctacagccagagcaaaatctgttggtggtggtcatatgcgtaaagattcgtatggacgcgtatcacacggactgcagaatccgttgccaccgcttccaacgtctatggcaagccagaatagccaagaagttgttgggaaagatacaagcgaaggcttttttgatgacgttcaattggatgatgttggatatcaagaagttccacaactcactgaatcggagatcattgaacagtataatatttccaaacctaatagcatgccatcaattgagcattgtaagacattgtttttgaaaggttttttcagtgttcaaactacatcagccaagccgttgcctgttattaggtataatataattaacgtgttgagtaagttgggagttaaattccaggaagtgaaaggtggatttgtatgtatgcacacgccttcggtacagcctagtcacagtaacgaacttgatgaggagaataaattgtatggcgatgccttcaagtcaaaatcgagtgattcatttgaagcagctgaaccagaaggatcaaaaacacctagtcgacaaccttcacttcagttgccgtctcataccccaacaacgccatcgggtcctaaatcacacaaatcaagtaactctattggaagcattggtggaaatgtgccaagacgtaagttttccattggtaatgcgtttaatacttaccgtaaaaagaatggatctcaagttatgatgccaccaaatacaccagctacagctaaagtgattcatgggttgtatgacgacgacgataaggagagaaatggtgaagacgacgatgacgaagatgactatggatatgatgattctgctgattcgctcaatggatatggtggtggtagtgatatgttgatttcttcgcgtattgagcaacgtgccaaacatcaacgaactgtcagtagttcgagtcagaaagctagcaagtcgccattgaagtttgaaattcatattgtgaaagttccattagtgggattgtatggtgttcaattcaagaaaatattgggtaatacatggaattataagacactagctagtcagattttaaatgaaatgaatttatagttacatagttgtatttatttaatctatacaccttcgaactggtaatctctttcaacaagggcgatccttactttgaagtaatcgtaaaatttcgatttccctaatttctgggccaattgatgatcagactgttgtttccattgttgaatgcttgacttgtctttccaataactaatggtaattccaattttgcttgtggggtcgcgtgttgactcaagtccaagaaaccctggttgttgtttggctaaagataccataaggtctgccacttgggtatattcatcactagtaatgtctgagtttaatttggaagtgaatgataccatatagtatagcggggttgctaaactcatttgtaggtggcgaggcaagaaaaagaagaagtgatgactaatttgacacaaataaaaaataaatttaatcgagaacgataacttctggttgttctggttctggtgtgggattagtttctgtttctggggttgactcattattcaattgtctcaacttcattctttgatctcttgacaatttacccgtatctatgttttcagtatttttcaatttcattcttcgttcaaatcttctttcggcagcatattttgattcttcttctctctgtctgtctaattcttcttgccgttgctttttggcctctaaacgagaacttcttttacgtactgccaataggttaaccatttgaatctccttacgcttgtttattaaatattttctcttttttatttcgttgttgaaaattgtgtcaatgatggcactagacttacctgccaatttggtatataacaatttatgggccagactctttttgattttggtcaaatattcgttgaactcgtagatgttcttgtatatcaattcaaatttaacatctttaacatcaaaaactttctcctcaaaataatcttgtggtgattcaggtgataattttcttttcttgggaatggtcaagggataataagttattgttcgtttgtataatcgattatcatcaaataatgaaaaatattcagtcagtgacaatttgaatagtgggtcaagtctagttgctagtccctgtttttccgtccaatctctgaacttggaatactttgaaatgtagttaattaaaatgtacaagatgtcaaacttctctgtgatgtttagaaggtcaaattttaccgaatcttgttcattgtctgtttggacaccaagtggagagtcactcccaaagtgagaacggaacacaaactcaaaatcttctaactcaacatgtttagagttctgaacagacgtgattaatgccaattttaatttattgatgaatagactcgataaatcgaatgcactgaaaaagcccaataattccaattcaaataaatcaacatcaaataactctgattggagttttaaatagcctcggtaattgtagagccagttgataacgaacacgtatttgttgctgtttcttaacgcaactaactctggtgtttgaaatccattttcttcttgttggtttagtaagattataggtgtttgtttggacaaggatgctatttggtcttgattaccaatatttagggaatggataggatgactagcatctattggcactggtgttgatgagtggcttcgggataccatggttgtttgtcaagaagagcttgaaaacaaatcgttgaaaaaattattagtatatacagattgctggtgagaattggtcttagtacacgattggtattatttgcaaccaggagacgcgtaccagaagttttcattgaagcatagtttctaaatttcttctcttgtatatttatgccaagctatagatggtcttaagtgttttgctaatgttgatatcaatactcgcaaaaagattcttgccataaacaagcgctggataaatcaacagtgtttgaaacaataaaaatctagttgtgtttcagtgaaatggacaagagcgcaaaaaataaaactaagcaagacaatgaagcttgtattatttcatccatgcctacaatgcttgattaaacagaatgacttgtagctgactgtcaaactacattagaaaccgaactttcctcagtgtatagaaaaagatcaaccacacaagtcttaaacagcgaatcttgaatttctctgtcatggatcttagtatggactccccctaaccaatagatgtaaaataattgtatatccttgttgggggctgttgctaacaattcttatcttatcattacttgttcttgcattatcaaacaacatctaaaaaaaagccttgtttagattcatcaagagagaaatcttatcgactaatcaggaattttgacgaaacccgcaaatatgtcttataaagaaaatgttcagataataataatactgtggtcaaacttgaaatgggaaaaaccatgttttacgtcatttacgtcattattgttacttgctaatattggtttagacgaagagcaagaagtgagaaaattgaaaggggggaaatcctagcacgagggcggagtaaaaaaggcggagcggggcggtggcaaaaaaaaattacaaaacaaagcaacaacattttagtggatgcgtaaatagtatcaaatgtttcaattgtggtggtggtgtcgagcgcaaaatcaaacaattcatttgaaacaggaatgacttgtttttgttgattctagtttgaagtttattagaccattaaatagagggggagaggacataggagatcataattgtcattaaatacaagtgaaatctaaaatttgaaagggggtctagaacaacagacctgttgaaatttcaattaaaattgatcaaaatttttagtgtaatttgatattttacagtatgagaagaagcactgataacgatagataagtgattgtaatatctctgattttacagttttaaactattccgtagttgtccattcagtgtcccttgactatccgagtcgtctccctcttgttaccattatagcttaatttggagaatctagtttattatttcgagtacgtgtgtgtgctgttgttaatagtaaatgcactgcaaaaccttaattctactagttgatcattcattttatttataaatggtttgtataggtggcagatatccaccacgctgccaatactgaaacaatgaataggaggaaaatatgaaactaagcaaatatgtttaattgcaattcagggaaatccaccgtaatcctaacggagtccataagaaatttgttggctatcgttcaaagtctatcgtttaaactcagattttgtagagatcatgttgaattgcggatcaacaattgagaaacttgcgcaacccctaaaacagaattttgttgagaaagtacggaaaccgccaccacataattaaaataagaagagttaggctcaagtaattgctcttcaaacatagttaaccaccatgtaagttttgcaacacgttttcctccacaatctatttcaataagccaagcaattacgttgagtactttacttaagaagattaaagttcaagtatcaactaccatgttgttggaaagactttaaacaaagaaatcaagaatcagaccatttatggatctactacagatactaaaataggggaaactcaacccaaccacaacaaccacaaccacaaccacaaccacaacaataactacattccagtcgttaaatcttttcccaatttctttgttatagccacaaaagcattacatgggtgagggatgagatggtactgtatattaacccaaccattgatgagatggattgattattgttggatctggacttcctttggaaaataataggaaactctgaaaataagaaaaaaagagttacaaaattgaattgatctgttgtgtaataaagaaaaatgaaatgacggtataaaacatccatgttagtaataagtaaaagcttcaaagcctttgcatacacttgaagagttgagagaataatatgtggaatgtagaatggtattttgggcgtgtagacgtgtagttgccaatttgccctttcaattctcattccagtatcatttctttttttttttggtactttttgagttggttaatgtagtagttacccgttttcaaagcttattttaatgtaataccaagtgatatacattaacgatacgaataacacttaatctgacatataactaagaaacaacaacagacaagaaataagtaaaaaaaaaagaaaataagttattatagaaagaatagaagccaatagaaatcaatagaaagaaagaaaggaagaaattatttgttaagaaatttgttggcagtaagtaacaagagagaaaacaaatcaagacacaaaacccaaaatcataaaaaaaatacaacaaaaaaaaaaaaaagaaaacttaaatacagaaacgactgaagacacagcaacaacaacaacaattattactagtagtattattatttactattaaaaatatcaaactaaaatattctctctctctcattatcttctcttctccgcttttaattagtaaaaatttatttttaaagtatataaattgattgtaatatcctctttctttatttcaaaaattttacttacttgtataaataaagtatatctttctgtcattaattgaatttgttttattttgtttatacattctttttttttgccaaattatctatacaacttgaacaactttttaccttagttgtcttcataacatttattaatagagctcgttaaaataaagaatggttaataatctcacttctggtattgcagccacgtcgtttaaacacaatcatcctcaacatgcaacttcccctccaccagcaatttctataaataccagttcaccaagaatacccaatcattcccctatttcacctccttcagctaacaatagcaacagcagcaacaatagtagtgtttcgggatttccattttcatctacagtgatttctcctagaaatagtattacatcgtttagtaacccaactaagcaactacgggctaacagtatcaacagtgataatggcaacaatagcaatggaagaaggacgagtaattccaattattcaatcacttcaactccaactacgaacaatcgatactcatttagtgaatattccaatgaacaaattattgatttaatggaaagagaacaagatgctattgtcttgaaattaatgaaagacattgaatttttaaaacaagaaaataaaatgttacgactgactcctggcggtaatagtgcacagtggcattgcatcccagtaatagaagtagtccttcaacaccaccagtcgtcgatcttcacataa

SEQ ID NO: 642 - protein, 80 aa, Candida albicans
NLGSNPNAKRMAEVVKFYNKLPQGPAPAAKKSNNPFARYRAAYFDGDNASGKPLVHLAIAVVIFGYSLEYQHLKHAQHEG

SEQ ID NO: 643 - DNA, 8405 bp, Candida albicans
tcacaaatgggatccaacttgccccggcaatcagtcacaattggttcgtcaatttggcaaatgtcgtgcaaagaatacgacgaattgataaacaccgggttcaggaggtcaggaacatttttgtacaaaaccgacttgctaagaagctgttgcaggttatacacaatcagaacaaaactcgaaatgtgtaaattgacgaaagagcacagaaaggtggtcaatcgattcattaaagagatatgtcccgaattgccccagcccaagaaaaacacttttgacttgaacagattatatgaggcacaacttcaatcaaaacgattcaaaactaggtttgagccatcaaaattttctaaagaaaagtttgaattgtataaaaaatatcaagtgtcggtgcataacgatgacccagacgatgtgactgaatcttcattcaaaaggtttctatgcgacacgccgttccctgacgacgaagttgatggagacaaggaccaatttgaaggacttgaactcaaaaattggggagaatcaacaaaaccacgagttggtcctacccacgaactatatttcttggatgggaaattaattgccatctccattcttgacttcctaccatcgggcgtctcttccatatattttatttgggaccccgactatgcacatttgagtttgggcactttatctggactaaaagagatgcaaatgtgtgacaagctaaattactcgtggtactatttgggatactatattgaggattgcgtcaaaatgaagtataaactgaaatttggtggtgaattattggatttgtgcaatgaagtatatttcccattagagattgttgatccgtatataaagaacggtagactatttgtcattggtgaaaaggacgacgagtacgattcagagcttgagattgagagtttaggagctccgttagactataaagatagtgatttttatgagaaaaagctagtcaacattgctgaggacatttacggggacgaaaaggtcgaggcagatgctaaaaaggccaagcaaatcttaaaagtcaaatatcaaattgatctgaaagactctcaaaaaagattgcctaatgtcgtaccgggaatgattcctctttggcaaattctcgaatggtttgatatgggtacaattgatgaagaattcgttgttgaaatatttatgggcgaaaaaatgtttgaatattctcttggcgaacttaatggtgaagggagagcaatcgtggttgactgtatcagagcttttgggctagaaaaagtacaggatatggtgattacgttgtgaaaaacatatattgtgttttttttttcccgcaatggaagattacgtccatagggtgagagtatttatgttcaactaaacaaatattcctgcagctattcccaatacgagagaaccaaataccgaaccggtgaccatcataccatcattgagacaatcactagagattccgtggatagaaatgttggaatagtttttggggctattttttttccatttagccaagggtagcaaggagtgccggtgactctttttgttctggtcgctgggcctagtttcttctgggctgtagacgttgtcagtcttattatataacttttctgtcagaattaactcttgttgaggtgggtcggggtcggtatcagaatggtaaatttccgatgataacgcttctacctcgtcaaatttgtaatcggtttcaagaggagtatttagttcctttaattgaatggcgtcatcggtttgggtgtattcgtcaatcaaactctgtagtctcaactcgtttgcctcttcaatatcagcacaagcaattttcgtcaaattcggataatggaacaccaccgactttccaataatataggactttgattttctgtttaacgacaaataagggtcgctgtatttcaactcaaagcaagttgtgttgatacaaccatgtttccccagcaagtcgcccacttgacagtaggcatcgtttttttgttcatcgcaaactggactagcattataaggattaaaatgcaacccaactgcttcgcaattgccgtttcctggaacagaccgttcatgtatatggtagaaaaatggtccttcatctttgggcaaccctgtcatatcaatatggacgttgacatgtttaccttctttagcactaaacaccacgtttcctttgacctgtgtatcacctccaaagggaaagtctgcaacagcaacgacgtttctagggtttttcttgattttaggtgacttgtctgaagcagctattgaaactagatagattaatatgataatgggaataaagatcatcttgctgagacgtttagtgataaatcttcacaaaaatatgaagatcaagattattatgacgatttttaaaagaattttaacttagattgtattaattaggtaaaagaataactttggttctgttgttctgtttgtgatgaaagctgcaaaaaaaaagaataacagcattttacagcataaccaataattatagtttgctattgtgtaaattttggttaatttcgtacaaaaaattgaactaaaaattattctcagcacgctccatccatcgcacatgactaatccccggacaggaacttatggaacgatgcacaacgaaaatgtggcgcgacgacacaccacgcaaaaaaaaaaaacatgacctttctcgcccaacaatttccccacacttactcacacgagccaacacaatgagtaatcccaatcttagaaagaagccaacaacctgctaggacagctctagtccaccactaccaagccatctaaatccatcggataaattatctctgacgagaatagactttttttgtggaagcaacagatgcctcacttggggttgtaatttttttttaggtcacacgtacacactacatatctcaccccatacaaaaatccccaattaggttagtattgtttcaacccccccttatttttgcaagtataaatatgtccataaatcccgaataattgaataaatttgtttcttccttttcttcctcataatcaattacattaaacaattttactttaactttattacatcatgactagaactaacaaatggactgtacatgaaaagagacctcaagaaccaaaatggtttacacacaatggccactccgataccgatccaaccaaagtaaagaagaatggtgctggtaagaacaattggggtcaaccaggtgatgaattagatgacaatgaggttcgtcattaccaaaagtcttcaggtagaagaaactccaaccacgaaatgaatcaggagagattaaacaacttgaatgacaaattagataaccaattgatgaattagagaatgcggttttgtatttatatattacgtagttacgaatttacgctgacgatatatcttctcattgttgtgactgttcggattgttgcaatttcttttcaatctctgctttccaaccctttcttttttgtctttcttcataagcctgcttgttggccaacactctgttgacaataaactcagtattcatgtcgtcatacttatgtttacctattgtctcgtaaacagacagatcgattttatcataaacgcctttatctatctcagttggaccgtggtacactttaacaaccttagacttgcccaatttgctaaagaactctggtgttgggacatatggtgcgcctaatattattccatcaacatatctgcattgcaaaacacataacgatctttccaaaagattcattattgggtagtttagccccttgtattgattgacctcagcatcatcatgaataccaacaacaactttggctcctaactttgtggcctcttgttgtacaattttgagtatttcgatatgtcctgggtggaacaaatcaaagccaccgtcaatgtagacaatatcaccaatctcagctttaggactaactatctcttccaattcgccacgattcaaataaacaccagatcctggattcaacccagtctcgtcggtggcgtatcgtttaaatctatccaaattgtctttggtcaacaagctttcggtagttctcagaattgctggatagtgatggtctttggacattaacaacattctgccaaccaaatcagtagtggaaatgttcggagtacgtttaacaacaacaaatctgcccatatccttgactacctgataacagtcctcaccattggcatcagttgttatatcgtctccatgaacaacatatggacacccatattcatccataaatttgggatcagtaacatatggtgcgttggcaattgcctttgtggtccatttacatgcttcaacagcagtaattctctcatccaatttaataactgtggggaccttatttagcaaaatttcttcgtccaagtgtacaccaacatacaactccttacccaattgacgtgcttgtaacattgcccccgcgtggccctatcatatggttagtacttcaattttcagcactgtcacaaatcaaaaaaacataccatggtgagcaaaatcaaagcacccatcaatccagattcgacaattttcaattccttctggcctttcgtacattattgtagagcttgatttgaagaaaatgtgatatggaacaaggaaaaaaaaaaagttgcaagaggatcaatatttattgttttgtcttgatgttcgcacacctcgtgtacattacataatcttacataaacccagattcttgttggcccaccctaattgaattgttggtagttggctttttcttaaatagtccagtggacttgactgtttgtggccgagacccctgtactgaactgccagcgtttggctgaccttcataagttcctgctgtcattctggcgcctacgtaactcacaccctggcccgacaccttatgtttaagcattttctctaaataaatataaatcattcctgcatttctcgtcgaacaagcatgtagccaaccaaaaaaactgccaatcaccggaggaaacgtaatcaataaatcaatcattatattcgtctgtagttttgcaatgagcgtattgggcaaattgtaatttttctgtgctatgtttatcactctagtatgaaccccatacatgataagtggacccaacactggaaatatcaaaactaccaagggagccaatcccaaaccacagtctaaccccacagcacaactccctagaaaacacttgtcatcagtccatgcttgtgattgaatctgtttccatacttgctgatcatgtttcgttgctaaatctttgggaagacgacgcttgttcccgttctcatcctcaaaagggttaaccttagcattccaatgttcttccccatattcgttgaaataatccattacaacatcatatccagggatattttccaattgatcttgaatttgtgacatgtcgattagtttgctagcaaaggaaaagtgataaaaaaaagaagaagcaactgaaaaataccttcgcggctcaaacttgagttgcgctcaatttgtctatattcactggtaccatagtaccattagtttccttgtgacatataaaacacgtccctttctttttagccttatatcggtctaagaaacaggctttgcaaaatatgtgtccacactctgtctttattggtgacttatagtcactcttacacaagacacatttaaatgggatatcctctttctctttaacttctttttggccaccaatttcccagtctttcttaatggggatcttttgcctagattcatctcgtacatgaagaaacttacacgtatcaccatacccacagtacccagtttgttgaaaatctttacacacgtccggttggaaatcggtgataatggtggttttgatatttgctgcaacggttttagttcgccctttttcgatttctgagaaacaacctccacagcagcagcatcatcactagaagatttggacaaaggggtttgtggtgatgatcggggcatcaccaccgattttttctgtatgtctgacttcttggtgatgagggtactctttttcgttacctgagtatcaggtgcatcttcactggcttcatttatatcacctatctttcgcttagatacccgtgaatcctttatgaccctcttcttaaacatggagctggattagtaattgtataaaagatcgacttgcttatttttttttttgcgtgaaaaatccgtgctaaatccttcaacaccattccttttttttggctacaacgatctccggattttcaactcttccttgcctccaaaaaatgattacaagacttattggtatagcaaagtcagggatctatcgcacatacctgaccgcttccttctatgaattgtttcccaaaaactttccacatggtggccccccacaagattcgtttattgtgaatgacaaatctttacgtcgagagtatcgttcgttacagagtgaaagccatccagacatttcgtcagatactattaaatcttcaaatataaacagggcctatacaacgttgaagaatccatatactcgaattgcacatttcatccacttgaaactgcccaatcatgtaaatatcaccgacgatgcggtggccaaaaaactaatcaagaattaccagcaaaagtcaatggaagcgtcaatgaactataaggagatgcttatgcaggtaatggaagcccatgagcaactagaattagcagagctggaaaacgaattggagacgttggaggccgaaaacaaagagcgtataaaaaccaccgaagaaaggatcaaccagtcactaaaaaacacccccatagattgggaagagttaatgatggatgctatccggttaaagtattgggttaatatacaaaacggaatcaaagattgggaaccaggtaaaccagtccatctcactcattaaataagctattatttacctctttatatttattattatacacgaaaagatgtacacacacacatatacgtcaattattctttccttttatacgtttctttactcgctggccattgttcgatcgtcatcttcttcttccacttcgtcttcttcttcgtcgtcttcttccatctcttcgtcttcatctaagtagctaattggaacattatattcacatgagtcatactcttgtttttcatcttctgtctttggatgcattcttagccatttcattcttggaccggtggcactcaactcgttgattttgaacccaaacaattttagcccaaaatcattctgactaaactttgttattcttattctacactggttttcaatctcgggaaacatcttcaccaatagtccaggaaacgtcgttccaaagaatgcaccatcaatattcaaatacctcgaactggaaggtatatagatatcattacagcaaggacaaaacaatctcaccgtttcttgtcccggcacatcagtcgacccaacaggaattaaatgcataccgtcacaaaaatatcttggacaagagccaaagtcgtttctctcaaacttggatgccatggcagttagaccttgtttggagactatgtatctggcatggattaaaccatataataattctgcagaatgtgccaataacgctttgtttggcaattctgatgcatttcgtttacttgtaccattccgtgaatcattgttattgctggtattggtggttgtattgtcagtgttatgatcttctgccgtttcaacttggtaatccaatattgtgtataatgcttctctataataaggtacttgcagagacaatccagttagattgaaatcatcttcaataaagtcctgtgacacctgtacaaaataatcgtgaccaaacaattcacaaaactgttgtatccaaggtatatagtcttcttctggatcgctaggcattgtagttgatatcacggcaaagctatgttaatcttaattttttttttttccgttcttgttttatcaatggaggtaaaaaaaaaaaaaactagtggtgacaaaattgtggatagacaaattgaatacacctaaagtttgtcgatatgtataataatattaaacagaccagtaagaaaatatgggaatgataaacaccactattgttattgtaagggttttctcttttgattgtttttgtcgatgcttagggaaaacttgaggcaagaaaaattttcttttctcgctgagtgttatgactgagtgtgtgtgaaaagagagctttcgaaaaataaaaaaaacacataccaccagagacgagttctaccaataatgcttttacctgatttacatccatatactatattattatcaatatttcttgtgcttgtagcaaaacaattggtggcaaccattgggaaatccacaatccaagaatttgtatggttggtatatttaaaggtttcctcaaac

SEQ ID NO: 644 - protein, 79 aa, Candida albicans
MTRTNKWTVHEKRPQEPKWFTHNGHSDTDPTKVKKNGAGKNNWGQPGDELDDNEVRHYQKSSGRRNSNHEMNQERLNNL

SEQ ID NO: 645 - DNA, 2004 bp, Candida albicans
cctttttttttttattgttcttttattataatattcagtcaatataaatatctctgtcaatttattcagctttaccaccttttctttgaatcaaagcttttctatctttgtccaaatgtaatttagtaatgacaactttagatggatgaatgttgattggaacagaagcaccatttgatttttctttttgtaatttatcaacttgaatagcaaatttcaatctataaacagaattaactttaccttcagaaccttttttagaacctctaacaactaaaacttcatcattttgtctaattggcaaagatttgacattgtattgttgtcttaattctttggataatggagcagataaaagaactcttctttcaactgatgaagcagtgaaataagcttttctagctttagaacgagatgaagaaacgtctatataaatggaatttttgttagtattttactgaatgtttcttagtctttgttttaataggaaaagtaagataaggaaggaatatattgaagggttatgatttgatttgatttgatttttcaagttttccattcaacaagtttgaaaaatggaatctcctatacataatttcatcaatatccccaaattgtatttttaatattgaaattcaatattaaggatgttctttatattcaggtaaatcgtgaaatcattataccttcttggtgtagtacttcagtcaatggtttgttctgagaaaaaaaccctctttattgaaactgtattaaacttaattcttaatggttgttgtttgatgttctatctccttttcaatgtatatattcctttatttctttcttttttttttttcttttccttttatcttcctttctccatatctaattgaatatctatttcataccttgactgatcttggccatttttgatgattatatgctatctagtatcgatccaaaaggaatttttttttgaaaaaaatttgaatatcttcaaattgagtaagtgtatagagagatgaatttttcgcactgtggtctagtgtagctcctctactcaaaaaaaaaaaaatatatatatataatgtatttggtaagacaaactgtgcgtaacaaaagtatttctgatactgcatatacagtacattagggctatagccctaacacacatttaaaatttggcatttaccaaatcaacatcaaatttcttaaaaaaatataaaacgaatagaaaaaaaaagacttttagtgagctatacttattacagtcttctctatattgccaaaaaaaaaaaaaaaagaagccagggaatactcttatttcattataatgtgaaagaaaatttggtgggttcaaaaatgagggtataattagctccccgcgggactcgaacccgcgaccctgagcttgcttgtcatggtattaatttacacaagacaccggaggcccaaatgctaaccaactgcaccaggggagcatatactacgttgtcacgtgacacgttgctgtctagagaccataatcataaccactgcgctatgtcagtgatatcactcaaaaaaatttgacctatttttccataccagtaagtttttggggtgttattatttagaaataaactcaatttactctaagaaattgatgattatttagctttctaattgtttggatagtcttttggtaagcagttataggtatttacaagtttatgtgtcgataattgttgatgataactcggtatagctatttgtaaaaacttgaacacataagcagcaattacaaagacgtagattgtatgacagtaaaccaaatcgattgacattataaatagtaaaaaaaactctttcatcaattgatggttatctagattttgaaaactgattgatagtttctcccccatttgtaaaaaattaaattaaccttggagaagaagaagaagaagaaggagaaaaaaatctcattaaaagacgaagacaaagagagaaatgtgccaccaccaccaccaaaagagaaatcca

SEQ ID NO: 646 - protein, 120 aa, Candida albicans
VSSSRSKARKAYFTASSVERRVLLSAPLSKELRQQYNVKSLPIRQNDEVLVVRGSKKGSEGKVNSVYRLKFAIQVDKLQKEKSNGASVPINIHPSKVVITKLHLDKDRKALIQRKGGKAE

SEQ ID NO: 647 - DNA, 935 bp, Candida albicans
tcttcttcttcgtcgtcgtcacgttccatctgatcgccatcctcactgctcatattttgttgctctaaatgtaatgtatgatcaactaagttgaggtaggcatacataaaattcgacaacaaaacttgctctcttagtgaacgcttagggttagcaagtttcaagtgtgacaatctataaatggcacgctcaacatgaactggaaatctgtagtcaagcatcactaaagttgattgagatggtggtggcaaggggaacccaaaggctgaatcagtaaactcaataggctggttggcccttgatgtacgttttattgatttcttcaacttttcttggatatctaatttctctttatcttcattcttagacaaaagatcttccccttggcttggtttgacactttgctcagttgcaagaacctcctctactacctctttgtttgtatcagtaagttcagtagaaaggttcttcttttgcatattgttccgttttttcctgctaattgatttctttttggacaattcgtcaacttttagcatccccaaatctttgttatcattgttattttgaataggagtttcatcctcatcaacaataactattgtgctctgaatgttacgagatcttacatcttcaaccaagtcatcagtaccagaatctaaaacatcgtccttctccccaagagtgacaaagtcgtctttgagatgttcaatgttgaattgatgtatcggcgacgaggttacagggaactgttcctcctgttgctcttgactctcaactctttctgccttacgagtgccattactttgtcgcaaattctctttctcctcgatcgtctgcgattcgtttgacactaaattcaaaggtcgaagcttttccttattcactgaattctcttgttctgacaatttggccttgatttctcttgaataact

SEQ ID NO: 648 - protein, 98 aa, Candida albicans
IKRTSRANQPIEFTDSAFGFPLPPPSQSTLVMLDYRFPVHVERAIYRLSHLKLANPKRSLREQVLLSNFMYAYLNLVDHTLHLEQQNMSSEDGDQMER

SEQ ID NO: 649 - DNA, 3616 bp, Candida albicans
acgatataattggggggaacaatatattggttgaacttgaaatttgtgttagatgagtgagttttgatataaaagggagagatattgtagagataataaatttcgtcacctggataagtagaagtttattctatttatatatcaagcctttttttatccgcgaagataagcattgaaggctatggagcggatttcgaaacatctgataaatccaatgagtttgacaactagtctagacttgttactgccattttgttttattagtcgtcacatcaaacagtaaagcaagacatatatgttagcttgatggactaattgcaaatcagctcattaattgagtcaaaccccacgactactacacaacggacaacaaaactaatcaaagcgaataaagcaaacaatgaatggaagaacacagaaataaagattgtgtagtgagaaagaaagaagagaaaaatgagttctattccgcagcaatgaaagcaaagaagcaaaggaaaaaaaaaatctaattctaaggagttggaagaaattgtaaatttaacacacacaacacaacacaacacaactcctaataaatgaaatttcttccttaaacgtcacattttgaaattttcaatcaaacaacattcaaaatttttttctttttattttttcttgctcttttttccttcttttcttcttcttattcaaccccattctagtatctattagatatcaattgttataatctcaaatcatgtctagtttccaagctcaagctcaaaattatttatctcaaattgataaagtatgtttaatgcacagattttctcatttgccatttcaacgacttcattcttaaccacagttttgttatcttttaaatttctcaagataacagaccttttttcaagtctttacgatataaaattcttaaaccatctactaacgattccatttcatagtctactaaaaatttcggtgttttagatcaatttgaacaaagatccggtttaccaagatcatatgctgttcttggtgctggtggattatatttctttttaatcttgttgaatttcggtggtattggtcaacttttatccaatattgctggctttgtcattccaggttattattcacttgttgccttgaaaaccactactaaagatgatgacaccaaattattgacttattgggttgtatttgcatttattaatgtcattgaattctggtcaaacaccatcttatactatgtcccattctactatcttatcaaaactggattccttatctatctttcctcatttggtggttctactttggtttacaatagtgttatcaaaccactttctgataaatatgtcaaagttgaaaacccaattgctagcaaaattcaagaaaccgctgaaggtgtttctactggtgtccactattaagttaaaccattttcttgaaatgttgtaatagagaatactagtgtagcaatattttctgaatttgtattatatatatatatactttatttatgcaattttttgaactaaatatatacttgatatatacagaaagaattcatttatttcattcattgtgaacatatacacattcaacatcttccaatccagttaatgccaataatttgatcttcttatgtttgatgaatttattcttaacaatgaatttttgtaattttgaattccatttgagtttacgatagtatggagttaattttgctaatgtgggatacacttttagttgaacagttttaccattggctaccggacaggcatacattattgataaacttgacgtaatatcaaactctggtgatatacgagctccagttaataatccaaccatataataaaatccagcatataaagacaatgccatattgtattctacagcaagcttcttaagcattgaccaagtataagctaaatctccatgagcgtatttgttgtctacggtttcatgagtcataacaataatctctgcttggcgattcatttcataactgacattttctgtataaaactcaatccaattcaatgggatagtattgttaaagtggttttcggagctcgattcattatcgtcggggattaaataatgggttgtgtctaataattgaataatctgtgttggaattgacgttgcaaaaatttgcgataattttggttgcaaagtttgcaaattatcaaaataaaaaaattgtgatgcaagtaaagttgaatcatcttgataagaaacaccttcaattggggtgatctccatagaggcattactgacaatgagcaacaataagagtagtgattgcatggtttaaataaaacaattgccaaaaaaaacatatttcatggtgtgagtatcgtagttttaccacagcaaaaagagacctcatacacaacaagaacttctttcttaaacaatatgatttagactagaataataaacaaagagaagaacccaatcaagtaggtaacaagtcatgaaagactaagaggaccgaccaatgaataatcacaaataatggattactcgatatcaattctttagaacttcattcatatatcaatttttacccagtgatgcagaagtccttacataactataaccaaaaataatatcacaagcaggattcataacccgggatgaaaatatacccgttagatctgccaaacaaattaataataatccatttgatgtattttaatttgcatcctttatcttttaggcattctggcttgatggaaccaaaaaaaaaaactcaatcaaacctattaatgtccaataatctaggttatgattgacgagtagatgaatcaaggtcgtgtccgtcgcgtacaaaaagaaaaagaagttgaagaaattttagttttaaagttgtagaatttcagaactctaagaagtcattctttaaaacaagttgtacagccactctcgagagagaaaaagataagatacaagatttcaatagaaacataatgatgtcatttaatgtaagcctatttccattatgctgggattaaattaagtgaaaaacaatcttactggaaaaagaaaaaaaaaagaaatgagaagatataaatacggctggggggtagaaaaataagaaatcccgaaggttgctgtctctcactatggtcgtgcgccacttaccaaggaacgaaaatcgtgacaatttatttttccagttgcttgcaatttcagttacaacactagtagtcaatgatatgtacgattatgtaaaggacattaatgttcgtctgtctgttgctaaatcagtttaggtctttataattttttattattcgcacatgctaatttcaattgggattttagtatctcactattaccatttgcagcataaatagcaactttaatcgattaaacgaggctggaaagacaattagggaggagaaaatatgcagattccacagagagaatacatttagagtgatgaattccaacaaattagacgaatggaaagtgaaaaaaaagggcaagaaaaagagagcaaataccaaaatgagcaatattgagaagtttgtggcgatgcgaatggtagcagttaatctgcaagtttcgtgtaattcattggatcattgttgtgtcagggggggtgggatac

SEQ ID NO: 650 - protein, 149 aa, Candida albicans
VLDQFEQRSGLPRSYAVLGAGGLYFFLILLNFGGIGQLLSNIAGFVIPGYYSLVALKTTTKDDDTKLLTYWVVFAFINVIEFWSNTILYYVPFYYLIKTGFLIYLSSFGGSTLVYNSVIKPLSDKYVKVENPIASKIQETAEGVSTGVH

SEQ ID NO: 651 - DNA, 24142 bp, Candida albicans
gaggaaggggaaacaatttattggggaggatgaaaggttagcccctaaaaacccccacagtgggggttccaaaattttggcaccctccatcttggaaaaaaaaggttatccacctgcttccaagtaagaaacattttccaattggtacaattgatagacaggaaacttataactgatctcttgtgaatattcaaaagaaaaaaaaaagggaaaaagaaaaactttacttaatccagcttagtatcatatattttaatcttatttaatttaacgttactactaccaccacttcgatttcctcgaactacatattcagaacacacaatatcaataatagaatgtcatttttcagagatttattagaatcagttgttccaactgcttatgctgaagaagtatgtattatgagcttattcattatttttttttgaacatgtaactgtcgttttagatggtttatctttgcaagcaatttcagttatactaacgttacattatatttttttttgtttagccagttgaagacgtagaagttgaacaaccagaagatgctccagaagaagaagtttccgaagaaactgttgaagaagaagaagatgatgatgaagatgatgatgaagatgatgaagaagaagaagaaactgctgacccattggatactttgcgtgaagaatgtaccaagaccgctgcttgtaagccatttgatcaccatttccacgagtgtattgagagagtcaccaaagaacaagaagaaccagattatgaacacaaacactacaaagaagattgtattgaagagtttttccatttgcaacactgtgtaaacgattgtgttgccccaagattattcaacagattgaagtaaattagatgagagatagtataactactgtgggggataaaacgttttttgctttgaaaataataaggacataatttcaatacgtcatattcaatttcaactggttcacttattagtattaagttccacaatccctgtctttaatgacctttttcattgcattttgccccatttcctacactgctgtctaatatctggttgaatgaaaaaactgaaaaatttagaaaaaataactatacatataaccttcttcccatttgtcaacatcttactagtctgccaatttaggatgtatatacttccgacaacgaagttttataaatgagtgtattttccaatgtattcatatatataattaaaaaaaactattgttataactcgtactctggagatagaatgtttgatctagtctgtagttgatcacgtgcatttctcagcaattgccgattaattctacgtataatgcaacttctgacgagcctcactttgaccaactcaaagaacattctcgaaatattaataaaaaaaactacctgattagaaatatccttagtttagaaagtgattggagagaaaatatgtaagtgaaaagaccacacaaagatgtatagtaaacccccttctagaaggaaatttgtaaagtatatgaaagttggcaagatttattctacaaacccattctgatggctcaattcaactattggatggatgtgtacatgtgttagcttgatttagccgttaatagtaagttgtaagaataataataataaagaaatcatccgcctcgaaatgcataaaatatgaatgaaagaaaagccgagaatttcctaactgcaaaagaagaacgaggtgagtgagaaatttaggccaatttggaaagctcgacaactttaaatattgcatatgcgctttgcatatttccggtatataaacctatattgtgcataaattgtgcatattttatgcatgattgtagcaagacttacacatagcaaagaagattttggccagtaaaaaggctctattttctgacaattttttagacaaaatataagtttcctatttagtactaagtatactttaagtatttttcagacaaagaatcttatctcacgtgctaagtgtttgaaatcactttaaagtcttcaattattcacataaataaccactttttaataaaaaataagctcatattaatacttgagacccctatattacccctagtcttgtttttacttacaaaatagtgcttttttagaagttctctacttttttgcaaactttcgcagtaaaatgggtataaatattgtcaaaaacatttttaaaatactaatcttactattttaaccttaatcaactttatgaaaacactcaaaattggtattaaatgatagctccatgtatctggtatacatactactaccaattttgaacaatagaagtcattatctactgtaaaagtgtgttttattgagctgttttatagggtattattactacttaatactgtggatagatgatttgaacaaagtacacaccaccaaaaaaacaaatatgcaagatgacttaagcaaaatttgttagggaattctcacttttctactaacaattcagcctataggagcagggaaaaaattgtacaaaatctaccaaagagagctctgacattttcagagacccaataaaaattcgagaaatactatggtacatccgacaaaaagttgttaatagttaggatctcgcgtttgtttacttttctatataaacaaacaccactttataagaaaccacaacaaatacttaaaaatttttttattaagtaaagtctttaaaaatcctaagatattttgttagtaatagttgacttgtaagctttatagaggtcatttttataagtatttactattagaaataatcaatattaagtgtaaacttaaatttcctattcatttgactctacttagtgtatatactaggcaatttaagctatataaggtgataattcttagtacattataagtaaaacaatcaagtattcaatactttaacatttgactcatttcttttcaaatactcagcaaaagatgcaatcagatcgtcgttgttgaacattctgtagtacttagcttaaaataaacccatcaaaaccactttaaaccaatcttgagcacaacaatttgtttatttaagcttaatcaacaccttttagctaagttttcaccttcaaataccttctgcattggcaatcactattgtcgattccaaataacctcaaaattatgctaatactagctcttggatagctgttagaccttatcaagcaccatatactttatttttttgatcttggcccaaatatatcagcaaaaaacaaccaaaaaacaacctcatgtccacaaacgatgcttattttaatttctagcaccacaatcttcccgaaaaaccagctattctaacaaattgttaggctttctttccaaaaaactcaatcaaaccaccaaaaaatacgttgaacaccgattcttgttaattattattcaattgggatctctaataacatcaaatttgttttgaaaaagcataaaaaggataaatttctgggattataccttattttaaggaaaaatcagcttcaaaatacaaaagatgttagtaatctagtttttaaaatcagataatatggcccataggcattctaaataattgaattgatactcaccattcatttttaacatcaattataaaagaaaagacttggaaagtcacatttgttgttgttttgttgaaaaagaaagaaaaaaaagtggtgggaatatggaaaaattttgttttgggtggatttgtttgtttatagttcgttggacgcgagattttgtcggattctggtttttctgacgaaaaatatttgaccaaaaaagacagaaaaatatgggtgtacaaaaccaaatttatgcacacaaaattaaattagtaggtagtacaaaaagagttgtcgagaaatccaaattactctcgaaatttattgtggtcaattaattgtacaccatcacactacttttacttattatctgtcattctttcttattattaacttttagtgttccgcaccaccaccaccaccacaaccaacagccaacaacaaccaacaatcaacaagaacaagaaccaccaccggaccactcaactcactcgcactcctcgaattcttttttctttttttttctgctctctcttactcaatttttcttttttattttcgaattctattatcattcgaatcttcttaatcaattgtttgaatttgaacttgaaaactttgaacttgaatctgattttttgaatttaatcaatcaatcaatcaatattgaaatcccttaactgaaatcaaaggtgaaaattaactgaaataacaaagcaaagcactttttataaaaaaaaaaaactccattgtacatataattagtcttgatttctttgaaaaacaaaaaaacgaaatctaattactcaaaagcaaagtattaattaatcatgtctacttctgaagaaactaaagtcaccaaaccagtcattgaagacagaatctacgttggtaatgttgatttcaaagccactgaagatgaattgaaagaattatttcaagatttaaaagtcactgaggttgaaatcccattcaaggagaatactcgtggcgataaagttttcaaaagacatttaggatttgcctttgttcaatttgaaaataaggatgatgctgataaggccattgccacttataatggtcaaaaattccaaagaagaaacattttcatcaaaaaggctgttccaccaccaactgaagaagaaaaaaaggaaagagttgaagctttcaaagccaaaagagaagaaatcaaaaaggtaaaagaacaaaagaaggctgaagctaaaaagaagagagaaggggctactgctgacgctgctactactgctaatggtgaatctgctaccactgattctacaccagctatccccgatggaactccttccaaggataccatttttatcaccaacttggattacaaagttaacgttaaaactttgaacagtttattcaaggaattgaaaccaaaatggatccatgttccatctagaagagttccttataatagaagaggccgtggtggcaagtttagaaaaccattcaacaagggtattgcatttgtcaagttttctaatgaagaaacccaaaagcaagctgttgctgaatttaacggtaaagaagttaatggcagagaaattattgttgatattgctattgactccagaattccaaaagaagggtcaactgaagaagatgttgatgatgaagaaaatgctgaagcaaatagcaatggtaactaaaacaattaagttaaataaaaacttataaccattaggcttcttattcttgttttgttataattatgctatgttgttgtcttgcatttttacattttcctaatgggatgtgtcgttcatattgtcattattattagtatgttgtttcctttttttttccttttgtttgccatttggttattattgctgtgtgtgtagtatgtgtatatatatagccttgtgatgttttccatttgtttgttttgggcattgctgtatacgataaataaggagttcttaattgaatttttttctttatttatatataatggttatatagagattgccaaaaacaaaagcagaaacaaaagtacaaaccagtttttagtgtacatctctgtggttttcatgaatcatgtacaaagcataaattgacaatgcaaagtagtttgtaaaaagtaagactactaatatggtagttcgtaagtgactactaatatggtacagactcaattatattctcataatcgaaaaaaaaaaataagctgtgagaaattcaaacttacaccaagaagttacactttgttttaccgttcctattatctgttgcttgtgttgcccagtatgagttaagaatgaaattgtttccaggttcagctcaattatttacttattcagtatagttgtgttggagatgaaggtttacaagcttagatatgttgagggtaactagattatttttgagcattttttgaaaaaatttaccagtaaatatactactctcaaaagcatagccaattaccaggtacgcagaagtagacacaaacttattggaagcaaactcaaattactggaaataatgacattcattaaatttcaccatcttcattgaaaaaaagaaaccatgaattctattatgctattaaaccgacctaacagttatagtaaacattccaaacaaaagaagattgaaagggtcatatttcccgtgttgttttctggttcaattagaacaaatatggatatacaaaaccaatacctggacacggaaatattggattcattgaaaaaagttcatttatttactggaaaagaaaatcaaaataaatttagcaatttagacacagttattactgaaggtggtggtaatttatctcatggtgaaagacaattagtttgtttggcaagatcattattaaggaatacgaaaatcattttgttagatgaagcaatctcctcaattgactacaatacagattacatactctaacaaagtttaagagaacactttaataatctgaacattttaactattgctcatagacttagaactatcattgattatgataaaattttagtcttggatgctggtaaagtagtagagtatgataatccatatgtattaattacaaacacggattcattattttacagaatgtgtgaaaatagtagtgaattggaaagtttgattaaattagcaaaagaagcttatgtgtagacatttatgtatatttagtacataatattataataataatacaattgttcatcatttattttttgaccaatgattcttccatagcatcaatcgaagtttcaatttcatccattggaattccacagcttaacgaaattaatttgcaatatttatatagcttatcagtacttggatacgtatcgatgatggttttagcatttggattttccggtaaaggaacatttttggttaatttagaaatctcatccacaagtttctttcttttgattatttccacttgtagttgcttggctaactctaattgttcgtgcacattgccttgttggtgggtttgatcaattacaaaagacgaagcgtccaacaccttttcgtgtaatctttcctttgtcattcgataactatgttcaactttatctaattcatcctgttgatgcaactcctgatatgtcaaatcgttcatcaaccggtatatttcttcttggagaatatgatcacgtttaaaatctagatgcaaatcattgccatgaactgaagtaggatcatcatcatctgttacctgctgctgctgttgctgactatcatctttattttgttccaattcttcaatcaaatgatccaatttaaaaaacgacaatatctttctttgtgattcgagtttgatttgattaatctggctcaacactttgaaatactttaatatcacttcgtctttctcactcaattctgaatcaatggcataagctaattgtgtcattttttctgtaaggaggttggcagtggtattttgcaaattgatggccattttggaattgtgaagttgggtctcaaatgattggttttcgtttgtgtaatcttccataatgtcttcgtcaccatcactattgttactttgatcatgttccacaggatccaatctgagtacgtaattatgtgatgccaaatagtcttcaacggtacaagagaccaagtttcttaatccaaaattaataaatcggtggtaattgataaatactttaatacattttttgttcaagttgtgggcagcaatatgaaaggcagtgttaccatctgaatcttggtggtttataaatttggtgacaagctcatcctttgttaagtcatcttccattgcgtgtccattggaatccccctgttcctgtcgctcatcgacaatcttttccaataatgattctaagtagtactgagcaaatttttcccgtttgtgcttgctatccgtgtccactatatgatgcaaaacggttttgccattggagtccaccaataatactgattccttcaataagtctagaattagtgggaagtttcttaattggaaagaattgttgaatttaaccataaacattaaaggtgtttcgccattgttatttctcacatctggatttaaggagtgggtaaatgttttcaacaaaaactcaaccatgtttaaattccccatagagcatgcccagtggaaaatcgtattcccgtcactgtcaattgtttgatatatatggattttagacaagggtagtggaggactaagtaatgaatctggtatcggcgatcgtattttattattgtcatctaggaaatatgacaataggctttgaaagtagtctgaatatatttgattttcctgagataaagatatgcttggttgatgatacggctgcaacggcaggtagtggttatgttgttgatttgcccgtttttcaaaagatgttcttgaaactccaaataattcctttgacgttaaaagatctgcctgcgactctaatccatttccattagtcattccgccagggtactttctcctttttgttgtaaatgaatcgttttggaggccatcacctctactaccattatgatattcctcgtcatcgtctgtttctacagatgctaggtcttcctgtcgaagattcatattgttggtcattatctgtaacgcatcttgctctgtatcgtttcttgcaaatgaaggtaccacaccaataaatgagctcttggcactatgatcatttgcattaaagtcaattaaacttttatttattggagttgtgtctgaacgttgtaaggaaggagttgcactcaatgtggcacgttttggtctacctctctttttcggcaccgtggtaggtggcacagaagtgctgctgccaaaactagtatctgacaaagttggctgcacttgcttttccttttgctttttcaataacagtgcttgtcgtttggctacattcaaagcggatgcatgattgtgttttggagcaggtgggggcacttctgtttgtccttcaatatattgaaactcaaagatgggttttaaaacgtcataaacaccaaagtttctggcaattgctgctcctaaatctaggggaacataggtcccctgatactttccgtacccaccttgaaccttttcgtgaatcccagtttgaacgtctttttccaaaatccttgtccgtttagcctttggaaacttagcaatcttcaaaatatgtgtggcatttatccaagagtcctttttgcgtctcattattggtccttccagagtgacaaactcaaatgcggggacatttgaatatgttgctgaataaatttgagagtctgacatctagtgtttagaaagtgttattgatgtgatgggttgataaatgaaatgagcgaatgctttttgtttcctccctaaactgttgcttgttgttgttgttgatgttggcttattactaaatgtaatagaaataagggatgagggtaggcggtgagggtgtcaaatacttatgccttaaatctactagaaacacaagtcaattgtgattaatatatgttgatgttaattgtatcaattgtattaatgtaattatgaacttttcggtgtcgttctatttttttttttctcgctcgttctctctcgctctatctgtctctctgtctgtgtattgataatattttggaataaaattgttaaactttcaaattaaatgtaattagagtatttcaaatggtgttgtttttttttaagacatttaatgaacgagtttttctttttttttctcttttctcacttttcttcttcctcccccctccaactttgaactgtctggtgctgctggttgcccttagtatgttttcctttttttctttgttctcttgctcccctgcccaacttgtttaacttatccattaatatctacaattaataagatgataatattgattataaacagttctatataataaatattttacccataccatgcccctaatttcacccaaatagcactttaaacaatctataaaacactacactaatcaatattagtaacagaactcctatataagcaatgtatttgccaagatactccattgcacttttgcttttattgggtgaatcctctgataaaggtattgttacaacatgctcagcagcttgatagcaaattcttcttctcgatataatctcacaatctcttggtggtacatctcttttcaaaatacccttgcctaacaatatacttgtgtacagtgtcaatgacgcatcaaatgccaagaaaaaagtttctagaaagatggactctctttctataccactcgtaactttttcaactcttctcacattttcaaacgtactttcgtcaaatgtgacaatctcgcctcgggccattttgtcgactgggaaggttaattttaaaaactgttcgattttggcaaatgaatcaagaatagatttggttcttacaacaagtgaaggaatcaacaactttttgagattatcataatgattgaaaaacaattcaatacatgacaaacttttatagaccgtttcaaaggcttgggttgcaacgtcaataatcaataatgctgaaggaacaatatctccttcgtatgttttatcctcccagttggaattgaacttcttgtattcatgcatagtagtgtattgtccaaagatatcattaaaatcatgctctaatttcaataaatttagttttgacttgttggccattaacgttacatcgtcataatgggggattttcctcaagaaggtagcatatatggtgatgatatccagatacaagtggactagatttttcaaatttataatggatctaaaaactgcattatttagacaatatttgaatatctcggggtgtgtgattaaaagttgtttgtcagattccaaaagattggaatctaaagttattcttctatctcctattgtgtatggcatgcaattaatacaacaaataaataataaaaaaaaaataaagattggtgaaaatgctaaaacttaaatgctagtaaaaaggtacaataatatagttgaattcaattcgttgatatctatccctgtgtgtgtgtatgtacgtatttttattggatggtccaccagagatagctttttttttaacaagaccaaaaagtagtaatagtaattagtaacagatgaactttgagacgaaatggtgcagtgaagtgaagggaaccaaaaaaaaaataacgatgagagtaaatgtcgcatacacggcatgatgtcgttgtgacatttttgtttgcctctttcaaaaacaaaatttcaattgctacacgtaattaagttgtgtcatgttattattattctccgattactatctttagttttctttttctttatcagaaagcaaccattaagaaataaatatcatttggaactgcaattgattttgattcattacactgccttcttctttttttttttttttctttttagtgattagataatgggagttttcagtatctttggctccaaagagtctttcgacccgaatgtgttcgaaaaggaattgacttcaattacagagaaaatcaataccaacaaacaacaaattagcaagttacaacagcgtcaaaaatacgtaagaagatccttgtcaagatattttatcatcatctatctctgtatttttgggtattgttatgccaccattccttcaagtactatcggtaagaatcgagttcagtggtttataagaggtcaaactagacaacacttgttggtgttaataggatacccgttgttttcagtgttgactttaagggcagtctcgtacattttccaatttttcatcaataataaacagagctatttaaagagcctacagaacaagcacaaggaaaagatcgaagaattgaaaaagattaccaactttaacaaaacgaatgagttgatcaataaatatggaaatgaaaagcaaccacaggtttctttacagaaacaagagcctcaaccaatttcaaatcaaaaacaacaagatcatttgagaaacagacataataagctgggaaatctccgagatcaggctatgaaagaattgaacttgccagaggacaaacaattactgtcacagcaaaaggggcaacttccaaatacaaagcaagctcctattccagcaattccacaacagccagctcaaagaacgattcaagacagattattggatatattaataggttcagataatagcgaatctgtcgaaaatagatatgctttgatttgtttccactgttttgctcacaacggactagcaccgccacatactgaagatccagcagatgttaagtttcaatgttggaaatgtggtgcaatgaatggtaaaggcatgttattcgaacagccagatatgaagtttgactcttcaaagaattcatcttctgagttgataaacttggaggttaaagaaaaagaaagtggaaatttagatcatccaggcacagagaatgaagaaaaggaagagagtacaaagaagttgcaataatgaggtatacagataaatatatacatatatcatattagctagtcaatatacacacgtattatctaagacaaatccataatagcgttgaccatgtcaccgtcgtgatttcttaaagccttgacagccttggctctagaaacttgggtttgttcaacaacaatttcaatatcttttggatccaaaccagtttcgtcaatctcaccttcgtcttcttcttcgtcttcagctttcttgtcacccaaagaagccttttctaaatcagcagtaatagcttctggtgatttgtcttcggttttaccggcatcagcagcagctttttgtaaagcttcttgttgagcttgttgagcttgagcttcagcaattctttggttcatgtcatcaactttagcttcaccaaagacaacataagtaccagcagcagatctgtagacatccggggaatcaatggcataaatcaagtttcctctttgtttgaaagtgactctggaaatacctttgatttgcttcaagtttaacttcttgatcaattctctagctttcttttcgttttttggaatgacattaacgtcagcaccttgtgggatttcttcgatagacatagttatagttatttaagtatatgggttgatggaggaataagtttaaaatgattagggttattttccactttttttttttcagtgaaaaactgaggtttgttcgtcgacaacaattgagaaatgaagcaaaatttgggtggtgtcgttgagccctaaaaaaaaatgaaaatttttctttttcacctcaaacatatttacccggtaaacctaccctcatcagagcactataaatagaccatctcattatcaaaatttttttttctgtttttccccttcttttttcttttctctgtcgacgtacttcataggatcatttctataggtcacgtccctctttgactcttcaaaagagccactgaatccaacttggttgatgagtgagattacccttgtaccctcaaagtgagaaataacatgaaatttttgcttgactgtgattctttgcaatctggtcatctacttataatgttttgcctttgacttgatgctagcctttcttttttgaaggtaatgcagctattataaaggagcgatgatctttacccttttcattgtgccttctaggaggattttgaattgggtgggtacaagtggctgtctgacaagttacaaaattaaatagacctattaataatatacaaaattattactatacataactttctacaaatgtaaatttgagcttctcaacaagcgaagccaaaaggtatccttgtttaatcaaacacattttgtcatcgtttgacaaacccagattggaaaatttttcatatccaaataactggtatcaaaaacaggcatcttaatacagatcacaattgctagagatgaatatctcaattttaaactttattaattatcctggatattctgtaaagcagagagaaagaggggggaactatttgtttcgttatggtgataacgtttgttcgttagaaagcagcaaattgataattccgtgcaatttccattattccgctgggcgcggaatagggaatagcttccaatatacttggacagaaaacttttccgcctcagagaaatcgcaaatactgtctccaagttcgtatagctcaaaccatcgtttgttttgataattcgtagtggcaatcccatgatcatacttggtaaacgttttgaatagctgtaaacttaatttggcttccatgctcaagtgtttcaatcgtcgaatcaaaccccatgtttctatgatgcactgcacaatatcttaaaatggaaacccaaagatttttacatgatgaaaatccccatttactcaaaatatgatctaaaaaagtttatcattggtcaaactggggtaatggacaattatcttatctatattagcaccgatagaaactaaaataacccacctgaatgtagacaagaataaggaaaaagtatataataacaagcccaacctcccataacctctttttacaaagtcgattttattcatttcaacttctccaaaatgaaaagtgaaaaagattctgaaattcaaggtatcaacatagaacctattgtttcttttactaaggaagaccttcaacttgacaaatcccatgtgttgaccactgttatttctccttccggtaaggaagtcgccattaccaatgatgttgaccaagttatgcaatttgtcctcgaccaccaaaatacaaaggtcgtattagacgaagccactgacaaaaaactccttagaaaaatcgacatgtatatgctaccagtgatgtggttaatataatggttccagtttatggataaactgtcaactagttatgcatcaatattagggttaagagaggatttgaatatggtgggtgacatgtatagttggatcgctacggcattttacttggggtatcttgcctttgagtttcctgcatcaatgcttttacaacggttccctgtggccaagacagtgtcagtattcattatagtatggggaattattttatgtttgcattcggttccccagtacccagggtttattgctttgagaactattttgggaatgttggagctgagtgtgacacctgccttcactattatcacctctcaatggtataaaaaagaggaacaatttctaagaacttcgtggtggtttgcatttaatgggataggaactattcttggtctggcaatagcctatggattatatcaaaacgatggaaactattctttaccaacttggaaacttgtatttatagttacaggctgtttaaccatcttcttgggatttgtcgtcttgatacatattcctgataccccaacacaagcatggttcttgacagatgaggaaaaattgttggtcgtggaacgtattagaactaaccaacaagggtttggcaacactcacttcaaaaagaaccagttcatagaggctttaactgattacagatcatggttacttgttatttatgctttatcaagtaatatacccaatggtggattaaccaatttcagtggtatcttgctatatgaggatttccagtacagtgaagccaaatcactcttgatgcagatgcctcaaggagcagttgaaattgttggttgtgtgttgcttgcctggtgttctcaattcatttcatctcgattattgatgacagttttcacaacgagtttgacaatcatgtcagaatgtctcttagcgttttatcctgaaaaaagcggtagactagttggtttatatcttcctatgcttgaccctcttggatttatttgttgtttgtcgtgtgtatcctccaactttgctggacataccaaaaagatcaccactaacgcaatgtatttgattgcctattgcacagggaatttgattgggccccaaacatttgttagttctcaagctccacagtatattggtgccaaggtgggcatgatagctgggagcagtgttgctttattgtctttgatttgcttatacttttcctatgtttgggaaaacaaaaaacgggattcaaggacgatggttgatatgagccacattgaaaactatgaattcgctgatttgactgataaacaaaatccaaactttagatatagcaagtagtggtatagctctgcgtagtttattcagtaatgcatgtctattgaaaatgtatgatggttttagaaaggaatcactacataagaagattgatgatgctaggattttcagtaacagaacgactaaatgactatttttcttgtggtgtcgttgcacagtaaaagaacaggattacacagccattacccattgacctcaggcatctgttggccatgatatagtagtgataaatcaaaaaaagggaccaaaattattgccaaaaatatacattagcatgaacttattgtatctattattgggaaaaagatatgtgaatcaacaagtattgaactttcgaccttcatgacggtttgtgttggctgtgagtatttttgtgagactagtttactgtataagcctttcaatggtttaatacagtctgccctaaggcaattattaatcaggtcagtatgcaatgcagtataatgcaaggaatgtcaatcctttcttttatgttttggcatgcttgttggagactgccacataaaaaagaaaagggaaatatcatcattgatactatataccttttctttttacatttatcccttctttttgtctagcctttatattactaagtcaagagtaatatccattctgtcaacaaacggcgatgattattaattgccaaaagtcgcatgccaaaaatccagtactcttcactctaactccgtctcccgaagaatccatttgatttgcgcctaaatattattttcttttacgatttcttgcaacggccgaaacggcccagttttcaatgtttagtaataacagaaattatataaataagagaaaccctgtcatccttctccattcttctttcttgatttcatcctgtgattttcaattcaaataacattagaaattatcaaaccatcaaaaaaagtaattaattactaccaaccataatgataacgaccagtttaaaacgatcaagatctttattgaataaggtgttacctatcgatattgaaggtgataaacattcttctccttcagtagtaacgaggagttctccaattctaaatcatgattcagagtctttacacctgaataaaagcccagcttccaaaaattcaaataaaaaaacatctaaatcaccaagtaggcaaggatctaataataaaaatactaagaaaactaacgggcataaaaagcgtcgcaattccagtcatcagaaagaaagaacagaaaaatcggagctttcacaatcaaaaagaggatcagatatactcgatcaaagaagtaaattagattggattttaatcgtggctatagggtctttgattcttctcatatacattttgaattgatgaaaaatgaatactgtgacagcattattgttataccatttgaaaatgtatcactgctgactaagacacgacagtatgctggatggtgctgattattgataggaaagaaaccaccagttaaagtgatgttccatagatataggactaccaaaaagtcgtgtgtaatgttacgagaagcaaatattattagttgtgtagcaaaattttataccaagagacagagaggaaaaaaaaaaacccaatttcttgaaataatctttctttcattccatcttttttttttcttctaagaattcctttaatttgaaaagttcattggaatcgtcagatagtcaagtttatcaaacattctaaattaactatcttaataatttagggaatagtgtattatttgctttaaagatatcggatacttttttttccttttgagttttgttttgttttgttttatttagattagtttctatttttaattaatattctacattcgttattgacgactacaacatatcaacgacctagcacatccacccaccaagataacacaactacaatctatcagacacatctagcaaaatgagacaatttcaaatcatattaatttcccttgttgtttccataataagatgtgttgttgcagatgttgacatcacatcaccaaagagtggagaaactttttctggtagttctggatcagcaagtatcaagattacctgggatgattcagacgattcagactcaccgaaatctttggataatgccaaagggtacacaatttctttatgtactggacctacttcagatggggatatccagtgtttggatccattagtcaagaacgaagctatttcaggtaaatctaaaacagtttccattgcccagaactcagtacctaatggttattactatttccaaatttacgttactttcactaatggaggtaccactattcattattcaccacgtttcaaattgactggtatgtctggtccaactgccactttggatgtcaccgaaacaggatcagtgccagcggatcaagcttcaggatttgatactgcaactactgctgactccaaatctttcacagttccatataccctacaaacagggaagactagatacgcaccaatgcaaatgcaaccaggtaccaaagtgactgctacaacctggagtatgaagttcccaactagtgctgttacttactactcaacaaaggctggcacaccaaatgtggcctctactattaccccaggttggagttatactgctgaatctgccgttaactatgctagtgttgcgccatatccaacatactggtatcctgccagtgaacgagtgagtaaggctacaattagtgctgctacaaagagaagaagatggttggattgaatgagggaaacggtgcttataacttagataatgctaacattggatttcatttttcatttttttttgtttggtttagtttgtttattagcttgttaaacatgtaatactgtgtttggtttgtataagttgattgtattttttttttttttggcaaagtagatttgaagtaggctgtgtggcgtgtcctgcgtaggtcgacgatgatgatgatgacgacgacgcgtttgtttgtcgaatgagatgtcttttttttgtctatctttccgtttagtacacaaaatccattttctgaaagccccctttctgtcgtatgcagtattttttttttccttcgccataatgaacaacaatgaaatgaaattttattatcattgggcagtggattaactttatatgaatttcatttatttttttcgttattactttttcaaaaagaagatttaagcaaagtataatataaataaagtgttagaggttgttccattatcacagattaaacatttatacttttaataatcaagccagtattgtttttacacatcactgccacacaacgaacattgtcacctcaaaatacctgctatctgttaacaagccactacagacttttaaaattttaagaaacaataacatacagatccaagctcagctcaagacacaagcaaaaagaccgctcatactttatcccaccacatgtgtatgaatcgaccaaaatatcaagaatctcagtcagaaccaaacaaacttgaacttcctttacagatgccttccactaaatttgatctagaaaagcaacaatcacagtcacatgacaaacaacactgtgcaaataagagaaattatctttataagttgatttttttattcaacttcattagtttgttaatactagggttggtatattattccacagaagtaaatcctcagatttctgccaacctaaacgaattattatataagatggagaaatgcaatgatttataagcgggttcttcgaatcgattgcataggttagttacttgtttttttgaatatatacatacttaaagttgactttagtagatattgtgacaatggaattgcgagcggaatttctgtgcgaaccagtatcctgattaggaaggttgcgcgatagtgctaacaaccgcaaacacagctcccgcaattccaactttcggtacacatatataagtatacaagtatacccttcattcattttgataatctacccaaaagaaaaccagaaaataaccccaattgtcctcggttaggaatattcagatatgaaactttacatttttgttttggttgcatgtgtgtcatcacaaaccattttcagatcaccatcacttcttgatcaattatatggagaattacatggaagaacaaacacagcaccaaatttgcaggtacaagcagaggatccaaatcagatggtcacacaaaaggttttagcaatgagatccaaattgacgttgcctgataaagatgatacttccgatattgctattgatcagaatatgtttggtggaatcttgacttatgcccatttcaatcatttcaattgtttcatttctgatgactttgataaacactccactacagatcaacaaacaaccaaaaatattgatatcgctattgttggggcacctttcgatactggaacatcctatcgcccaggagctagatttgggcccgagtcaattagaagtaattcccgacgtctaggaagtgcttggaaatcaaccaaaaaaagattcaattacccagttaacccatatgatgagaccactcataattactctattattgattgcggtgatgtggctatgactccatttgataatcgcattgctttaaatcaattgtaccgtggacatagaagtatttctaaacacccagggaatgtcaatcaacatcccaaaattatcacattgggcggtgaccataccatcaccttaatggcaataaagaacgctcatgaacaattgaggacaaaaattagagtatttcattttgattcacatatcgatacctgggatcctaagaaattaggtggtggaatcactgattatatgtcattgaatcatggaacattcttgcactacgctactgaattaggatacattgaaacaaaaggcaactatcatgtcgggataagagcaccgtatatcgatgctaattacgacaaacagcacgatgctgattgtggattccatattatccaagctaatgatattgacaagattggagttcaagggatcattgatgagttagcaaaagatccaaacattccaacttacatatcagttgatatagatgtattagacccagcctatgcaccaggaacgggaacaatggaagctggcggattcacgaccagagaattgttgagcattttggatgggttgaaaaataaggttaacgttattggtggtgatgttgtggaagtgagtcctccatatgatacaaatagtgaaatcaccagtttggcagccaccagtgttgtcgattcattattgaaattaatgattgtctaaagaaataaagccattccctaacaaacacacacatacataactttctttgtcactggttagagtggttcacttcatgttgaacacgcaggaagttgatctttgactccaattattatcaaacataaatcacggaatacaaaattattgttatttaagttataaaaaaatatataatatacatatttacaataaaattattctatgtcatgttattgactcctgttgatatgtaagtattttattttacgtgatttattataataaaatatgttttactgatacaaattgggaaaaagagtagaaataataaactgaagattattaataataataccaaaaaaaaaagaatactcaactatatggtccatataaatgacaaacggttaaactgagaacaaatctcattatggagttcttttgtttttgtaatatgctcatatgtaaggcttttgaggtgcttttcacatcagtagttttcagtttcctatcaagtatagatataacaaaaaaaaaacagaaagagtcaataaaagagcaatttaagttggcttaaacaaacgatagcaaaataaataaaattgctgctaaaatctatttcttttgatgccaccaaagtaattttttttttctttttctcttatttcttcaatttagcagctaatacaaacgaatatataatttcatgaattaaagcaaaccaaacaatcttaagtaataataataataattcagtataaataaattggggttgatcttcttttttttcattttgtatagatgagtttttcaattctgtttacccattacagcatagatttgatattttaaaccctcctccattcgaaactattattataaagaaagaatgacatgtcaaacggggagaaaatgttcacttggaatagaagaacctattgatatctcctccaaaaacgtgccacttaatgcgtttttaatttacaccatgtcaagcactctaccagatcacaattcgactaattcatggaatgaatatcacaacaatttatccataacaaataacactcaggtaacgacaagttgtgctgataatgtgaaaacaactagcaatgtccctcgaagtgcaactgatattaattccaaaatgacaacttctgaattcgaaactttacatagatgccggttttcagtgtgtgatttaaataatttggagaattatctatatcaatcagaaagagaggaatgcagcagagtaatagaacaactagaaacacacaacggcaaaagtattagcacttgttgcaattcaaatacggatattaatgctcaatgtaatcaaatgaaaaatcataaaagacggaaatcgattgcattgaaatttaagaaacctcaaacattattatgattggtagggataggtgtctgcttttatctgtggcttggatagagagagatatatgactatgatttagagttgctcacaatagaatgtagatataaagtttatgcaatttaatttacagacaataatacctgtttaatggagaggatatccaatgacaccactaaccttgagggactaggggtaaagagcaacatgctaatatatatatgaacctaaaggtaaaatagtcactgtacgtacaaaaaaaaaggctcacaacagtttcttcgcttattctgtgccgaaatataaactatctataaatctatttctgaaatgccaatgactatccaaaaatccttcattattataccaaactttgttattcgaatttgaatcttccatacttgataatttcccaacaacaattttcactttagggaacacattaacaattcttcttataccaatttctgtagataaatacgtaattaaaataatatcttgttctttaacatgatgatctaataatacttgaattgccataatggctccggctccactaataatttgtgaatcaaataacataattttatcagataatttatgaggcaatctttcaaaatgtaattgaggttcccccgtagttgaatcactttgaattaataatttaccaatagaaattactgggaatgattttttaattgatgccatgaagcaatctccactacgaattatattgactgcattatattgattttgtaataattttttaccatgataaatccctttaccagtatcgatatcgacattggtataattggtcataaactcttgtgctaattcaattaataatccacacatacgattaaaataaaatatgaaatcattacgtgaagttgacgtatcaaataaaatcgaattgattcccttgacttgattagtgttttgtaataatttaatattgaatttatcaatatcaaattttatattgacccctaatttcttcaatcgttgtaaatgatttcttgattttaatgctaattgattcttgatatgtttaatcattaaatttatggcaattgaattatctaatcctcgaggaatcaccaaatcagcattttgtaccgttggattaatgaatttaaccgcatttggcttaacaaatttctcccattgttgcatagctccacctaaatctcgaccacgatacaatatatctcgagttaatcttcttgctaaacaaatatccaaatctgtatcgacatatattttcgaatccatcatatccaataattgttgatcatgtaaagcatataaaccttccacaataataaca

SEQ ID NO: 652 - protein, 114 aa, Candida albicans
EDVEVEQPEDAPEEEVSEETVEEEEDDDEDDDEDDEEEEETADPLDTLREECTKTAACKPFDHHFHECIERVTKEQEEPDYEHKHYKEDCIEEFFHLQHCVNDCVAPRLFNRLK

SEQ ID NO: 653 - DNA, 1949 bp, Candida albicans
aaagataaagttaaaatcaattactatttttattggaaattttgttgtttttttttatctatatttttataacacaagtattattgtttataaatctaataaacatttttcacttttttccttatactggaacatcttctggatctgggttataaatccaatgttgaccgaaaaatgggattttttcataaaaagtcttttggaataatggaacaccttcagtaaaagtagcaacggcaccaccagcggcagctccccagaaaaccaaatttggaatgtaagatctgactaatggagcatttaatttaccaaaatgactcaaagctttgtaagctggacctttaacgtactaaaaaaaaataccggcatgttagtatcaaggtactactttctctaataataaaaataatgctaatattgctcttgattgatataaaacatatattatacatactgaaaccatattgtattgattagaatagttataaagttgaaagtattaacagtaattagttaactgtgtctatatttttttttccattctttttgttttgaaggattgatttttttctgcaaacttttgattggtctttcaacaggctaaatcacgtgacaagcacattatcattttaatgggatcgttttaggtatctacttcaagcattcctcaagtcaattaattagttgattaatattcctagaacagtaaaatattataagcacaattaagaaaacaccattggtctcagttaatgaaataaatacatttatatcaacttttcttcttctctcaccccgtattcctatttctctatattacataaatataaacaaactaactaagatcaacggccaatcttgtcaagacatttctttaattaattatgtaccgttttttacctgaataacattgtgtgcaccaaagataaagggcaaaacaatattctcttgtcatttacatacaattgtcaaatttaacaagaatctggttgagctaaaatataatcaatagtttgaccaacagtttttaaactatcggcttcattatcagggatttgaatattaaattcatgttctaattccataatcacttcaacaacatctaaagaatccaaacctaaatcagaagtaaatgagttttgttcagtgatttcacctttagattgatctactttatcataaccttctaataattcaataattctttctttagcaatatctctagttaattctgggaaggcactataacaacgaataaagttcattgatgaagtcaaaggagtgacatttttgttgttagtgatggtggtgatggtgaataatgatcttgatgatgattgaatggttttcaccattgaaggttttgatactgaagctcttaatgattttaataaagtagttctaaacattgtttaaatgaatatgtatatatatatatatgatggagggttggggggttatgttaaagtaataagaaagatggtcttttttttttctctgtttaaagaataattgaaaatattactggacaagaatcaagaatcaaaaatcaaagaaaagttaactgttacaagtgagtgagagagagaaaaattttttttttcttttatgatagaagcatattggttaatcaaatacaccaccatacaataatcaacttgttatgattagatcactattcaatggtattaggttagttaaacctaataataccaatatcaatggtattactagaccaatcacttcatatatgaactcaataaattccaacataccaatactcaaaaaccacaacaacaacctttcatcattcaatcaagttcgtcattcatcattaaatcaaattcaaaaatataaacattatgatccaaattaacccaatgtaaccaagtcaccagatttagattataatccattcaaaaaggggggtggattaagaataatggttt

SEQ ID NO: 654 - protein, 63 aa, Candida albicans
HFGKLNAPLVRSYIPNLVFWGAAAGGAVATFTEGVPLFQKTFYEKIPFFGQHWIYNPDPEDVP

SEQ ID NO: 655 - DNA, 15790 bp, Candida albicans
atgataaaggattcgtcaaactctctgaattgaattctaaaggactgcacataaaatattgtagatcctgttttacaacaagataaacacaattgtctcccgcacgtacgcacgcccctttctccaccaccacattttttcttcttgttcaatttccaatttactataaatatcttgcgattcccatcaccacctccttctcaacaatacaatacaaaaaaaaagcaagcgttcgaagaagtccaacttgaaagaaagcgttacttatatctagtgcagattatagctcgtttgggttgatgtatgacatgagttctttgaaattgggatcgggtttatgaattaacatgacaaagatttatgtcttgagtcatcacccctcccttttgtttaatattattaacaaacaaacagggtttattaacattacccacacattcaaacatatatgaaaaatgattaatatatgattatagcgaatcaattctttagaaattgattattgaattattatcttatcaacaaaaagatgttttataaatataaatatataaatatataaatgaattgattatatcgttattattattacccaaactgaacatgttctcaattatcattctgggaaaattaaagaggaaatattgtcttaattccaattgatttaaatcaactgataaaaaattgatccccctccccccctaacacttgttaacattgattaattgatgttgttgcaaatttatacgaattttgataatggaagtgatatataaccccttcttttttggggttattgtttttacaaactgagaaatatagggtactatgatagaaagtataacaacattgaacgaaaacaataagatttatctatctattgattacaaatttctttcttttgtttttattttgtttaacttatttatttatagatatatcaataatacaaacatatatataataacattatactactccttctcaatctccacccccccccctcttattaccttatggtgcccaaattttaaaagtttgaggagtttttaatgataatggtttaaaactatcatcttgtaattcaacatcaatagttgtgctaccaccagttgttgttgaatttattttactaccaccatcattgacatcatcaccagtagtactattattactagcagtgttattggtgttatcaccatttttaatttgctctaatgcacgtcttgtaggtttatataataatgatttagcctcattcaataatccattaatatttgttgaatcacgaactccaccaccactaccagtggcagtgttattgttattgttatttgattcaattaatttaattgcttcttctaatttttttattacaccaatagttgattttgttaatgaaattcgatcaataaataattcttcttgttgttttaacatattttgtcgttcacgttcataaattttttccaattcttcaactttatcaagtttagtttcaatttttgaaatttcatgattaactatacttgaaccaattttatgcatttctcgttcttcataatttgaaaataaatgactcctaccaccaattataccaaaagttgtagcaatagcatctttcccacttgattgtctttcaacattaccaccattaccaccattggtgttattattaccattgtatacttcttgaactttgttttcaatactttcatccattgcttttttagcagcttcactagcagctttagcaacattactatcaactaatttagtcataaatgttaaatttgctaaaacaggattatcaattgaactaataggataattagatgcatattttaataatttaatattagtttcatcttcatcatttataggattaaatttatcttctaatggtaattttaaaaattcaagtatacattgttcaggagttttattccctccaacttgatgagcaatcttataccaatcatttttaaatgttttaactgcactaattaaagcatctttttctgttttggtccagccatcttcttggtgtttcttctttaatggtggttgactcccttctatttctactttttcttcttcttctaatccatgtttcttacctttattcccattttgtttttgttgttgttgtggtggttgttgtggtggtggtggttgtttttcttgtttaacttctcctgagttagaattagaactttcattcatcaattgttgtaattttttcacatcaactctttcaacaggtatacgtgaagtatcaaaggggaaaagacctcttggtgtatcaaatttaacatgataatctccagtataaggtaaatccattgattgtccattaggcattttttcaagggcataacctggtttaaattgaggtctaacttgataatttattagtccccatttatttaaaaatctatgcactctcattaatgtcccaacatcaccaactaaattacgacgacatgaagttaaagttaaaaattcattaggatttaatcggtaggaatttatcatgaaatttcgataattaacatataatttaggtgatttagatggatgaattgaatcaaaaaattctggtaatgattctttttcaattttatggatttttttcatattaaaccaactagcatatgatggtataactattaaatgtgtttgtttatattgaggtttttcctttggtggttcttctggttcatcttcatcttcctcttcttggtcatcttcttcatcttcttcatcttcctccttttcttttgattctggttctacttctttttgttgttggtccatatcaacatctttatcagttgtatttgtttttacttctgaactagcaatactagtattttggtttgaagacaaaggttcagtcgctgaagcaccaacaaccgaagttgtagttggttgtgattcatttgggttttctcctgtactttcttctttaatttcagattctttttgatcacttgtagattcaacatttgatttcacttcagataattcagaattttttttctgttcttcttcttcttcttcttctggttttccttcttgttgattagattctgattctacatcttttgaataatctagatcatcaatttccatattaaaatcgtcaccatttattaaagcagatgtgtcaaaatcatcattagatttatcagggtcattattagaattataattttcatcaaatgatgggtcatcttcttgaatatgtttcaattcttcatcttcacccaattcttgtttagattcttccttttcatattcttcagtattggtgttttgtgtatttgttgtgaaagcaattgatgtttcttgaggaatatctacatccattttatcttgattgtcatcagcatcaacgttggttggttcctgtttttcagattcagaggcagcatcgattgcatctggtgcatctggtatatcaaattgcatatcattatcactattactgtcttgtttactgttatcattggaattggtattgtcttgatgttcgtttgactcaactttattctcagactcagcatcatcatcatcttgttgttgctgttcattatttttatcttcagttgggtttgtttgtgtttcttcggccgattcttcggttgactcttcagttgatgcttctgataaattaccaccttcttcattatcatttgcagcatcattgttgtctgaagattgttttgcttcagtatcaccatcttcatcttctttttcttccttttgttcatcttcatcttcattgtcttctgcttcattaacatctccttcctcatcgtcttgatgttctattgatgattctggttgttgttgttgttcaggttcctcaggtattgatgaagtagtatcaagaggggtttcctctggaggtgaagcactcatattgtcgaaacagtaaaatctattaatgtatgtatatatatatatgaaagtaaggataaatgattaaaaaaaattggttgcaaacttaaaaaataaaatataatgaaataaaaataaaataaacctcctgtggttgttctaattgttgctgttactgtgttttgagtttgttgttgttgttgttgttgttttaaaggggaaggttgtttttttttcttcttgcttaatttttttttcgttcgttcgttcattttaattttttgtttgtcgtttgttgttgtcgttcacactcccccccactcccactcccactctctccaaattgataagtttgaacagttgtacacgcacatgacattagttaagctttcacttattagtggtatggcaatatgttaaactcttgtctaagcttcagtctagacaagtatgtctagtcttttgagtaattagaacgtctttttctttgttgatattaatctctaactcatgattttcattattcttattatccacatatattatcttataataattaaggtaaaacaaaacaccaataaatgtaaggaatttaatagggaaactgaacagagtaaaagaaaaaaaaaaaaaaacagagaactaactaattttctaaaaaaatatttggcaaaggtcaaattcttctttatatatatatatagtagtagtagtagtatacttgtagacaaagagtaaaagggcaaaatggtaaaaattagggcaaatgaatttgaatatattcaaagaaagaaaaagggggaaaaaaaaaaaattatgaaatgaattttaataatttattttttgttttacagtttttggaattttcttttccaattatcccaaattatttaatggcttttcgttatatatttatctctatgttatatcccttttattcacttctctggtaattatatatatatatatatatatatattaatttattgaatttgtagtagtttgacagttgggaagtacgttaatcatatgtgtaatataaatagaggaaatattcaactaactaaccatcagccaaacaagaactgaaaagaaattatcaaatgacacaaaaaccattaatccatattaaaccaaaaaccaacaagaaaggacaatcacaaaatattaaatcatgcagaattatgaatatcagtcaataggaataagagaatgggaaagaaaaggaaaaaggaaaaagaaaaagtagatgggaaattttaactgcaacctgtttcttgctgtataattagtatactaattaattaatacttgatgttgatgttgttgttgtcgctggttgccgtctgctgtttgctgtctagtgtctactgcctgctatctactgtctgctcttttttttttgtctatgtaaaatatctaatggcaatatactttagtttttctcctctatttaaactaaactgcatgacatctatttcaatcggttgttgttgtacttatgcttgttcttgttgttgtgtaattgtggtatgtcatgcatttagagaaacaagttacattatgcccactagttgtcaccaagaaattagatgaagcgatatattagcccaagattagaaagcttgtcctaggtattactttttctcgtatgatattctctactacaaatgaaaattgcctaaccaataaaaatgataattattctccgtatatcgtagttggaaattaaatcagaatgaaaattccaccaaaccagaaccaggaaaaaataaaagaagagaaagaggaaaattacattataccatcaaacaggcgattaaagttaacctgacacaataatagaataactaaacttgaatgcgtgggtaacactctttacaattcaattgttcaccttgaatgaaaatctcttggatgataaataaatatatcaaatatcgtttacaaattaacaataaacttacaaattggactaattgatacacttttcattgtttgaatggagatattatactactcgtctccagaaaaattaactaagtatgtatgtatgttgttggtcaaacttccttgatgttgtagactgtgaaattgaaaaagccttgttaatatgttctttctgaaacaatcatgaaacaactgtatttggaaataactaacaccacccaattaataaaacagtaaacaagatatacatacttaaattcaatactaatcttagtttccttagttaccttttttttctttgttttattccggttgactatgtaacaatcttcaatcaatttccttttttttttagttcttcgttcaataattatatccttactcttgactcaaatattatacaaatacttgcctacatttgttcttcttcttatgatcaccaattcacttctttcttctgatcttactacataacttacgttgatgaccctcttgtgaagtttgtgaaaaattgattttttttttctctctccaagaaaaataatgaactcaaaatctaaataatactgcaatataagatatcaagcatatatggtaagatcatactgaaattgaagggcgaaaatatggataatcacataaatttcaacacaatcaatcggagtttaaagattgcacacacactaggaggaagaaaattaataagaaagttttgtagtttagtttattggcactgtcacagacagaatagtaattctatatgttttcaatttattgaatttagcttataaaccagaagctacatatagaataagtaagtaagctttctttttgtttattaacttgttctgattttattgattgctcttcgacctgatcataatcttttggaacaaataaaaaaaacgacactgtttagcgaaacttgaattaatagttttttctacttatttggtgctagatttagaggattatatgtgtccaatctgtaaacaagttgataacagtgacttcgtaataaacttccccggacttaatctctatcacaagtaagtataatcactctactaatctttttttgcagcaaattttttttttttctttctggtcaaacgatactttagggctatagccctaatccagtatttcatcctgcatagattcttagtatccggtctcgcaatacaagctatatataacagttttttttttctagtgacatcgcggcgttggctccaattttgtcgcgcaatgaactgaggatatggacctattgtacacgatttttcaaggcctggactggaaatatggtcgcactcataccaattttgtttagacttgccccctcccccccccctcccagttcgcagttcgcaattcgcaattcacagttcgcatttactatacaatcattacttaagtacacaacaacaatttcttctctcccctttgagtttgagtttgggtgagaacgaaaaaaaaaaattctactaacaaaatatttttcaaaggaaaaaaaaattttttacagttaactttttctccattgaaatccacattaaatacaattcaacaatggttcgttacgctgccactcctgctaacccagccaaatcagcttctgcccgtggttcttacttgagagtttcattcaaaaacaccagagaaactgctcaagccattaatggatggaaattagaaaaagctcaaaaatacttggaccaagttttggatcatcaaagagccattccatttagaagatacaattcatctattggtagaactggtcaaggtaaagaatttggtgttactaaagctagatggcctgctaaatctgtcaattttgtcaaagatttattaagaaatgctcaagctaatgctgaagctaaaggtttggattctagtaaattagttatttctcatattcaagtcaatcatgctccaaaacaaagaagaagaacttatagagctcatggtagaattaatgcttatcaatctactccttcccacattgaattaactttgactgaagaagatgaaattgttgaaaaaccagttgaacaaaaacaaatcagattgaactcaagacaaagaggtagattagcttctcaaaaacgtttaactgctgcttaaataaataaaaaaaaatggaaacaaataagggaatgaattaaagattgatagatagataaaagaaatcaagtcttgttcattcattcattcattcataaattcatttttttattatttggagagagaaaaaagcaaaatgtccatgtattgtatgttgcatgttttctctaattcttttagcggtatgttcataatgtatattataataatataaaatcaaaatattaaaaaaagaaagagaagaatcactttctgggatatcaattaataagatatatgtgtaaataacaacaaagttattaactctttacaaatatgtatatttgatgaaatttaacaaaatgtaaagaagtaaggacattttactttatataacgtatttctatcatagtaaatacctcttagactgtccgataacacaagagtttaaaacgatatgggattagagtttttagttttactattgttatactggaaaattgcattctttaatcgctctttcatgtaagcctggaaagccgatatcacttgttttagtgaggtcccccttcccatcttctggttgtgggataaagtttcatatcatcatatcaactattaaaagccccaattgatgcaaattgtgagactgacttcattttcatctacattaactggtatactccggaaatttggcatattaattataatccaaatcaacgattaataagccttaatataaaccctgggtatatatatccagatagagattaatttttgctatatcatttgatagaggttttctaattgtttcaacaattgtttttgcccatgtttttttaatagatagtaaatttaaattaccaattgatatgagtaaaaaaaaatccttaaaactctcttcagataaacataatattccataataatatctttcaagagtttcaaaataaaccatcaaccaaatatatgaagaacgataagtataaagattatgcttgttacataccataataagaaacaaacctagtatattcctgcatatagtctgaccaataatagaatagaaaattcaatcttacaaacccacccaccaaagtgagagagagagagagaaagagagacaacgaaaaaaaattcaaggaaaactaaatatcccatctttccaaatacaatactgtcttatcattaataactaactattcaataatggcaggtgcaccacatccacatacttatatgggctggtggggtagtttaggctccccaaagcaaaaatatattactcaatatactatttctccatatgctgctaaaccattaaagggggctgcttataatgctgttttcaatacttttagaagaaccaagaatcaatttctttatgttgccattccatttgttgttgtttggagtatttggactagagctagagattataatgaatacttgtacactaaagaaggtagagaagaattggaaagagttaatgtttaagatttaatgatcatgatcatcaacatttggctacatatactactaccattattgttgttgtactaagttttcccttattgttattaaatatatacataaaaaaaaaaaaagaattaagtcgatttgagacaaattatgaaatagacatcaagcattattttattttattttattttattataataattatgaatttatatctctatggacaactctctatttagatcttttataaactttacctaagaaagcagttaaaacatctttctttaaacctctagattcatcaatttgatcaatttgttttcttaatttagcaacaattgattcttcataatcatgataaattttttcaatacccaattgtttaaataaatctttacatttttgttctgattcatcatcttttttaccataattatcatctaataattgacgttgttcaggggtagcaatcaataaagcttgattaataacccaagaacatttattatctttaatatcagtaccgattttcccaatttgttctggagtaccaaaacaatccaaataatcatcttgaatttggaaatattctcccaagggaatcaaaatgtctctaacttgttttaaatctttttcatcattaataccactcatatacattgctaatgccacgggtaaataaaatgaataataagcagttttgaaaataacaataaatgaatgtttttccaaagaaaatttatctaaatcaacaatttcttcatcagcagtaattaaatctaataattgacctaattcagtttggaaagtgacttcatgaaataaatctaataaatcaacatagtaaggatcttgacggaaatgttttttcaacaagatataaatggccccttctaacataaatgaatcattaatagcaatgttgttaactccttcaactaaataccaacatggttgacctcttctagttttagattgatccatcatatcatcagcaactaaaaaatatgcttgtaataattcaatggcccaacctaataatgcaacttttttatattcagtatcatttaatttatcactagtagtattattcaaaatggcaaatgtatcaactacagataatcctcgatttaatttacctcctggagtattataatttaaacttctaacaaaccattcaatggcttcttgaggcatattataagaaactaaaatttgtttcaattcttcaactaaatcttcaaaaacatcaagaaatctttctctagcagcaagtttatcagacattgtgaagtgaatgagttggtttttggtaattggtaattggttgtgttgtaaagaaggaatgggtggttgttattaggagtaatttttttttttcatgatttataaactttcccgagggggggggggggaagaggcagatcgggtgagatcgtgtgtctgtatcaaatttatggttggttggttggctggaaagttcttttaagcgcataaacataaaaaacataaacataaacccaaaaattggacagcggctgatacgcgtaaagattatatcaaattagatcttacaccattggaagaaactattaccctcttttaaaatataaaacttattggttgtcagtttctatgttaattattcaattacttcaaaaggagaagaaggaggagaagaagaagaaggaggaggaatcgaattttttgtgtatttatttatttcaccatgtcgctatttatacatcaactctattctttaatgtcttctactacgtttacttttaccaggtcttgaagttgatttacctttcatctttcttgttgaaaatccactaatatcagctgatgaagcagcatcattttctcttttacctctttttttaccaccaaatccatatttagcatctttagccaatcttttagaatttggttttcttcttttattatcaccaccactaccactaccaccatggccatatttctggttattttcagttgcttcttctaaagcaatttggaaatcatcatcattactaatttcattagcacctcttttctttttcaatgatttaattttttctaaagtttctttcttttgtttagctctttcttgtaaagtagcatgttgaacttgtttaccaaattttttcaattgtcgttgtcttttagcttcttctgatgcctttttattggcggcttcagttaataatttatttttcaatttatccatgtgttcatcacttttaaccatttcagcaaaataatccatgggacgagagaatggaattttcaattttaataatgttttacgtgattgtttaacagcatctaaaccttgcttataaaatgccaattctctttcggtatcatcataaatatctttgatttctgattcagttttatcagcactagttattgattgatgctcaataaatgaatgttttgaccaaggtaattcaatacgtgctaatgattctcttaatgctgccatattattaatggttaatttggtatgaggaactatatcagcatcggaatcaacttcaacatcagataatggaatatcatcttctgcttcatcgtcattttctacttcgtcatcctcttcttcatcgtcgtcgtcatcatcctcttcctcctcatcattgatatcactttcactttcactagctgctaatttttccaaatccaattcttcttcgtcatcatcatcatcttcttcttcttcttcctcgttattttctgcttctttttcttcctcttgttgtttagtttgtaatttcttcaatcttctttgttcctttttagataaaacttcactttgataatcatcatcatcttttttggtatttgattttttcgatttcttgtttgatttcactttggtggtcactggggcggcttctatgatttctttttcttcttctactgttttttctgttactggggttttcttggttggttttgattttgccttatcaatggcatctattaattgatgacttttcaattgttgtttcaatatacctctagccatggttagttatttaatttagagtaatgaatgatatattaatgagatggaggaggaggaggagagaaatttttatgattttttttttttcctctatgagtgaaaattattgcgatgaggaaaaacttaactactattttttcttaatagtgtttgtttttgttaggattttccacttcactaatgataaacaagccaactagattgcaaaaaagtagtcaaatatctaaatgctaatttcattttatatatatatatatatatatatttaatactaatacaacataataatgtccttaaatccctaactctgtgtctatttaccaccattgatttttaatctcgtttataatcaatttgattaagaaatcgtttaccagaaccatatttccaccatcgaggtaaacaactatatatattagtatcaatggttcgatttattttatcttctgattgtcgagaaacacaaacacatcttttagaagccaaaacatcgtcagccagaggacatgccaaatacggtgcatgataatatccaatatcttcaaaatgatgaattgaatctttatcagccaataaactcaatccaatggtatgaactggagcatccccccatctttcataataaaacccacccgtatgatctaaatattggaaaaaagtttcatatgattcattacggaaaaaattcaaattaccaatttcaaaattcgaccaaaaatgacaaagattataatcagttgctgaaggaattaaatccatataatgatttaaagaaatttctttacttgttaaaaattcaatggcattatttggatgaagtaattctggatgttttttcataaatgattctactgtgggccaaagattaggaatagtattttcatattcagtaatggcaataataaatccataaattttattattaattcgaagaaattcaaatggatcatattgaaaatcacacatatattcaacatttggttcaactcgaaaataccaatcataattcaataattttttttgtttataaaaaaacccagaattaaaatgacacatattacgataagatctaactccaccataaataacattagttttagaattatctaaattttcttgtaattttgtttcattaataaatattggtggttgccaatcttcgacagggattaattcataaaaagtttcaccacttgccattaatgtggttttctccataaattcttcagtaaatggttcatcattaaggaaaacccaaggatatttataatctcgattgaatcgatcttctaatgatcgcattgattctaatgctccttctaattcgatgtttctcactaacattaccatcgtggcattttctttccctatctgtttcctattctctggtggataaattttgtctaaatattgattactagctaatttaggttgatctttcgctagtggattatatcgttgatatggtggttcgctgaactttaactcagaaaaatagttcaaaacaaagtagtagtaaatagatagtataacaccacttataaatgcaatcgaatagctagtcattgttggagatctgggggggatggtaatagtccaaagtgaatgtaatctgttagatgttaaaaatgaaacatagaacaacaataaacaaacaattaacagtagtagaaaaaaacaaagggggcgaaaaaaaaaaaaaagaattagcttgtcgatgattatgtaatatacgtaccgatctgagtccctaaatgcgaaccaaaatctcatagtgaccaagcacgtgatatgcaacagttgctagcatatttcattagaacaacgccgatggtaactccaataagattttaatcgatgtgttgaatttgagtgattgaaagtggtaacagagaagtcctccaaaacatgtatagtaatttagaagttagcgttgaatttttagtttttttggtactaaaatttgttgcaaaaatttgattcaaaaatatatttattattgattatgacatcttgttctcatggaattaaaaatacacaatcaccaatcataatatataaactacggatatcagtgatatagtaatttgctttaaggcaataagtataatgccatatgtttcagatatgactctctgaatcattttcaaaagaacaaaatgaattagactaacagctcggcaaaagccttttccaatcttacttcaatctccaatcaaagataaaagactaaagagttaatcgttaactggaagtccagtcttgcttagtttgtcttgtgttgcaaaacctatactaacaaagccagagaggcaagactatccctataaagagccccaaatagctttgcaattacattcaaattaaccagtatctgtttctttgattcaaaattcttggacactttcaacattgatatcgaataattgacacttgattaacattagcaacaaatacttgactaaagaagatctaaaactaattgtttgtttgtttgtgtggtagtgcatataactcaattattccaattctacccaataatattaaagcaaatccaattacgcaaaatttttttttttttttcctgctttacccaaattccaatattcttttaataaactcctaataaaaaacatcttgggttttctctctctctctctctctccaataagcatacaattaattttttttttagaaaaatttcccaattgtgaaacccaatcaattaaaacccataaaaaaaaatatagacaacattttccatcatcatcatcaccatcatcatcttatcattgttcaatagtaaactttaatttcaactttcttcctccatttaacacttcacaatatacttcactacctttcaatatatttatagattacaattgataaacacacctaacaaacaaatcataaactatgcttagcaattttaaaataaaaccacgcacattactacgtggattagccactgctgctgctgacccagctgccaatcctaatagagtacatggtggattaaaagatcaagatcgtatatttcaaaatgtttatggaacttatggtcatgatttgaaatctgctcaaaaaatgggtgattggtataaaactaaagaaattatattaaaaggagataaatggattattgatgagatgaaaaaatccggattaagaggtcgcggaggtgctggtttcccctcacgtttaaaatggcaatttatgaatccgccaggttgggaaaaaaatagtggaccaagaaatttggcggttaatgctgatgaaggggaaccaggtact

SEQ ID NO: 656 - protein, 93 aa, Candida albicans
GAPHPHTYMGWWGSLGSPKQKYITQYTISPYAAKPLKGAAYNAVFNTFRRTKNQFLYVAIPFVVVWSIWTRARDYNEYLYTKEGREELERVNV

SEQ ID NO: 657 - DNA, 7123 bp, Candida albicans
acacctcgatgcacctaatttgaaaaagaaagagatcaaacaggaaagatttgaagaatttcaaaaacaagaaaacaaaaaaacgtttaaacagaatcttcgaaccattggaagaattatcaaattggggaaaccagattggaaattgtttgtgttagccattggatttatattatgtgcggttttatacccaactacagccgttaaattagtggggtcagtattagattcatttaacaataacataaaagataaagatggcgatttaattgtctggggatataaagtttctactgtatttgcagtaatgataccgtttatggctgttagtgccgtttgcttctgggccagaatttgggtattgaaattattgggagagagattagtagccagattgcgtgctagagtgatgaaaaacttattgcgtcatgaccaagaattctttgataatgataaacacaaagttggtgatttgatcagtagattatcgagtgatgcatacattgtcagtcgatcaatcacatctaacctacctgatggattgaaaaacttattatttggattgttaagttcatatatgatgtatctgattaacccgatgctatttggaatgatgttgttaatctcacctccaataacaattggttcagtattttatggtgagaaaatcaggaaattatcgaccaatttacaaaatgccactgctgggttaactaaagtatctgaagaaactttgaattccataaaattaattaatgcatttactggtgagcaaaaggaattaagaaaatattctacgcgtttgagaagggtagttgatgttgcaaaacaagaagcatttgctcaatcaaactattcagtatctatttattcattgtaccacactggttatttggcatgtgtggccttgggagtttatttgatgacaaaaggtacaatgtcagctggagatgtggtggcattcaccatgtatctggaattcttcaattcagcattatacagtttaactactacatatttggaattaatgaaaggtgccggtgctggtgttaaactttttgcattgatcgattataaaaacaaggtccctgctatccaaggagaaaaagtgactacatggagacctacttccgtcaaggacgatatacagtttaatgatgtcacatttagttatccaacacgtccgaatcatacgatatttgaccattgtaatttcaagattgttggaggaactagtacttgtatagttgcgccaagtggtgcaggaaagtcaacagttgcttcgttattgctcagggcttacgatatacaactgggtgaaattttaattggcggcaaaaatataaaagatattcaagtgcgggatttgagacgttatattatcggtattgttcaacaagaaccagtgttattgtcagggactatattggaaaatattgtttatgggttgacttcttctgaaatcaacaggttgacaatgcaggatattatcgatgtttccaaacaagccaattgtcatgattttattgttactttccctgatggatatgataccataattgggaacagaggtgcttcattatcaggtggtcaaaagcaacgtatagctattgctagagcattgattaaaagacccaaagttttgattttggatgaagcaacttctgctctcgattcaaaatctgaaagtttgataaatgaaacattgaaaaatttgacaaatgaagggtcaatgacaataatttctattgcccatcgattatcaacaatttccaaatcggagtttgttgttgtgctaggtaaatatggccaagtcgttgaaacagggaaatttgttgaattatttagtaatcctgattcagagttgtcgaaattgttagatgaatctgcaacttcacaagcagcagcggatcgacaagaggaagaagaggaattacaacaagagaatcgtcataaaactcaagaagatgaacgagagcatattaatcgagaggcagaagaaatcgaaaatgaacaaattaaatatagtaaagccaagaatctaattgaatcattgccactggatatgaaacaacaattacttacagaaatcaatattgaagaaaaacacgctgattaaattgagtttatatctttctccttggcccgctttatatcattcatgtaaataacttgaaaatgtaccttcttatttttttttaatttagattagaaatagcaaaaaaaatttataaatatatatttattcgtattcttaaagacaattcaattgtatcatttgtcatgactgtattctatatccatgaattctctatcttaattaatattggatttgaaagatcctaaatgaaacatataaaaattcagttataaggaggaggctgtgggaaattgtttaattatcagttggtttcaatgcaactggttcaccttgtttaccatctttgaaagttataactttggcttcaacaaatcctcttttttcagcagcagctttgaattctggttttaaagagtttcttaaagtttgagcagcaattgctaaagctttgtttaatgatacaccagcttgtttgtatgcagacatgactagttgttatttattggtgaatagataatgaatactgtgggttgtgaaaatgtaaaatatcttcaattggattgaagtttttttctccttctttgattctttgttgaaagaaaaagttcggattacttttttgaacattgagacacacccaagttttttattggttgagaagattcatgcaacatggtagcttttgattttttttgtcccctttcacacgtctttctattatgaatctaaatttactattaattactattggatattactatttctacaagtctatatatttaactaagatttatgtttttgtttctggttttggttttgattatgagaggcattactcttcttactgttgacccaattgataaaatcgaaaaacaaagaaggttgcaatttgctttcagattgtaaacaccattgttttaatgagttgcaataaatttcaacaattgcttgcatatttgattcatctaaattcaacaagtttttggcaatgataatacaactttgattataactttgtacaactgattgattagatggttttgtagtgtttgcctttgtttgtaattcctcaattaaattgattaattgatggtaatattccgatggatcatcattataatatttctttaattcttcactgtcaattttagttttggagattttatttctcaataatttatgagctttaactcccaaatttttatctaatgtcaaattcatcaaattaatcaaaggttcaatgaatgccaaattaaaatgcagatttactgcgactttattaaaagtctctaataaatctaatactcgattcttgaagaaaatcatattttctttagcttctaaaacttccaatttacgtttgttaccagtggccaaattagttattgtgtcctgtcgttgtttgaaaattttcgataattgatcatccattgccatcatttgttcatcgtccattgaatcagattcataatcatcatcggaagaaaggtcatctaactcatcaaatttaacttcacctgattccttggtggggattcctaaagcttgagctagttttaaattagtttgtttgtcaatttcagtgatagtatcttcattgttgtctgactcactgacattgtcgctgtcgttgtcactatcactatcaatatcactactgctatcattctcgttgttatcttcggcttcttcggccgcttcatcctcctcctcgtcttcttcatcaccgtcaccttcttggaattccccatctccctcaaaaagtttttcttgaccttgtttattctctttggcttctaatacatcaaataatagtttaaaacatgcttcattgacacgtagtttcccgatctcatcaacttgacataaaaagttttcccaaactagaactgacaattttttaaataaagtagattttcttgaaataaaactcaatacaatttcagtcaacactaaattatcatctactttgttgtcatcttcttcgttgtcatatttgttggcggtagtgaattgattttcaaatactaatttcaattcattaatcacctggatagtctcttcatcttccatatacaattggatcaaacacattgaaaacattaattcaaaaatatacaatttatctgaagatttggtgtttaattcaatgatggtggataataattcttcagtttcttgtttaactatagatatttcatcatcaaattcaacaagacatttattttctggatctcgagataatttgttaatgattctataacaaaatgttgaccaagttttataatttctatgggaaagttttaaagtgataatttctgataatattgaattgaatttttctttacaaatagattgtaaaaattttgatattttaatatcattggtgtcgaaaaatgaatattgaagtaattttgttaaaatagattccaaaacagtatcagataatttgtgttgattattgttattatgtttaattaaggaaacaattttatccaaataccattttaaaatattatcattagaatttttattattgttgctagtgtcatccaaagttgtttgagtttgtaatttgatagtaaaattctctaataaaatattgatatattgattaacatttgtttttatttgtaaaatttcatcaatggtatgagatttactaattagatcaaaattccaacatccacctttagattcatctaataaacacagtaaaacaataggacccaattcaggcttggtttctcgaatggttttaacaaaagtttttaaagtttgttgagcaatcttgtataacattctcgttgatgatgcatgttgattgattaaacatctcataaaatttggtgtaaataaatattgaaccagtgaggttgtctctaaagatgtgacaaatttagtaaaaatttcaaacccccaatatttacgttcattagatgatttttctgaaaataaagtttcatcaacaacaactttccagaattcttttaatgaaatatattctggttctattttagcacgtttattattatgctttggtgatgtggttttctttctcttctttgaagtgaccaactgatcttgcatttcatcttcaacatttgaatcatcagcaacttgattgaatttggcaacgattaaatcccacacaaatggtaaccgagaattccaactactcttttgttgatttttcttcttttggtcatcccctgtttcttcatcactgattacttcgacatcttttaaaactttagccaacactggtaaatttcccttatagaatggatcaccatttttccaatttgctttcatattagttacattttgtgataattgggcactttgaggaactgataaataaattgctaaaccttcagttgacaaattcaatcccagattattaaccatatttaatatcttgatataaattttcttactatattcaacattactattatctaataattttataaattgtatcaaggtgaaaattccagtttctctaatccaatttttaaaattactcaattccattaaaatttcaacaaattgtaacatatcttccggttcacttttcaaaataataatttgagaattaattaatacttgtaaaccaaatagcctaccaaataaaactgctcgttgttctttacctttcattgaactggttaattttgtagtttcaacaagtaaatctaaatatttcccaacagttaaagttccccgattatttaattcattgacaacttcagttaatgccatactaaaaccaaattttgctgattgtctagtagttaaaatccctttaagtaatctattcaacgcatatgaccattcttcttcattatctgcagcaactaattctgaaattaacagagtggctgcattcaaacgttctttgggtaattcagaacccaatttaaaataatgatctctcaggactgccatatggtctataagggttagttttctagtgagtttcagttattaaggttagttggtggttggttgtcatttttttttggtccaatttgaacggttttttttttctcttacttctcgatgcctccaacaaccacggacccacccatcgcagaaaaaagattttatggttattacttctatagttttttgacgcgtttaactcttaaacatcgaatattacattatgttgtctacaaaattcactctacggtcacataaatcatccgtagcatatatctatcaagatccaagaactcctttcaatcttttcacggcagattcttctgggttaataatcaattgggatttaacaatccgtcgacctaaaaaatcatggcaagctcatactgataccatacttacgatatcaacaattcataatcatttattaacccattctcgagataataccattaagatatgggacgagtcgtatagctgtgttttggaaataccttgcaatgcattgaattttagtaatatttgtattatatatgatttattaattactcctgcaagtatcaattctaataatttggatgtttataaaatcgataaagattggcaaattacaagattaatatcggattttgatgtttataaattagttaataaaggtgaaataatagaagaaattggatcttctggaaccagtcgtaatgattttggtataataatgcaaatgaaaatcatccacactaacaccactaccaccaccagtgagaacaattctgattatatcatttatgtgggctttgaaagtggtgatattgtagggctacagttgatattaccacgggcaagaatattatcaactacaggaaacactaatgataaaacccttattaatcaatcagcgaaatttattcttcaatatcataattcaactcatgtccctaatccagtgatttgtctactgaatctagattcagtgttagtatctggatcaacaactaataaagtgaatattcatagtgatcccattgaaataatgaaaatggatcattcaggaattcaagcaattgtttactttaa

SEQ ID NO: 658 - protein, 50 aa, Candida albicans
MSAYKQAGVSLNKALAIAAQTLRNSLKPEFKAAAEKRGFVEAKVITFKDG

SEQ ID NO: 659 - DNA, 81440 bp, Candida albicans
  misc_feature (41180)..(41180): N = A, G, T or C
  misc_feature (41181)..(41181): N = A, G, T or C
  misc_feature (41211)..(41211): N = A, G, T or C
tttgatatgattaatgaggttttaggaatggtaatttctgaaagttttggtgaagtcgacattattgataattataaaaaggttctgatatgattgaatataataagataaatgaattgattaagattaattgagcaaataaagagtaagaaaaagaataattggttgatttgggaaataaggaaaaggagtgggggaggaggagggagtaagaaaaacttaaatatataaatggtgccgtatagaaaaaataaaagggaggcgcattcaaattttaaacacaggttaaattgttgccgccaagatattgtcgcggagagcacagtcggggtggtagtagtagtagtattactggcggtggtggtggtgcgtgaccctattgtgtcgcagtgggaaatattggcatgattagtaataaactgcgggctactatgattgggtgggtgtgtaaatgacctcaaggactagttagttagcaccaaagaaaaaaaaaaataatgactgtgaatcaactcagctttaaactcatttcttttttcgcaatttcagtgatcattaattgttgaaatatatttcataatgtaaagaacaaccagggttgaattgtccaccacaataagtacaagtatagccacaattgaggtattctgtaacggttaattcattcacacagttaccacaaagtacagccttggttgtattgtcatttttatcgaatcggtctggttcatggttagttgattcttgatggcatttaaagcatggataataattgttacaacatttgaattttatagcaatgatatctagtttagtatgataatgagtacatcttgtgtggttgtcgaccaattgtcctattagggatatgttgggagatattttttgaatttgagattcagattttgtcattatgaaagaaaagggaacaaacaaacaaacaattgtgtggattttagttctgttttggagattgaaaagttgtttgaaagaaagtttctgggttgttggtcaatctttaagggtaagtagaattgccaatgtttccaaacaatgatttttgtaataagaaaagattacttagtaattgtttagtagactatttttttccgtttgccttttttccgaagtgtagatgaggaatgactgtaaagtattatattgagcatcatcaagtacttatcttcacacgtctaacaaacagatacaagataataggcatgtttcatattacgactttacaagctttttttgtattccaatacaacaaagataaaactactgaaacataattgaccataaaaaattatgatctattccaaattgggtcaattcttttttaaaaagtagctgtttactgaaattaacgttcagtatttttacagctccacataattagtaaaatgtgcagagtatatggtgaaaaactcttttctctatgtctggcaaagttacttttccacaagcttttccataatgttttgtaagaaaaaagttaataaatttagttagtagatacgagtttttctcattaaaatgaaaaaaaaaaagcgactaaacacgtctagatcataaatcaaaaaaaaaaggggctcttcatgaatttacccttatttcggaaagagacaaaaaccttgatcctttcttacaaaactttggtaaagtaagtcataacacaaatctagaaccttgtcaactttgttaacgtttataattgacaaatattaataatttatccaacaataataatacgcgtctcatcatgggttttaaaaatacaagaaaaataataatttaaaattccttttaagtatacctcacaacaaccgcatatgaattgaaatatgaaattaatattttccattcgtaacttcgcttgtcaaattgaaaaaactagtaacaaaaaaaaaaaaagaaagaatacttattgtctatttcgttaaattaattttgatatgatagattgtgtccatttggaatccaggactaatttaacagaaatatcacaataattaattgtgtaataataacaacaacatactaaaatacaagttactaaaaattactcaagaatttgctcatcatttaagcatcacacacaaaacctattgagaccaaataaaaaaataattactgtattgaataatctgggcactactactacctactactactaatactatgaaattaagtgttgcgcgtcaaatatattttgaagttgacatgttgaatatctatatttcctttcttactaaaatatagatatagatataattataatcactgaattgatctagttattgttaagtgatttcaattgtggttttgtaatgtaaaaagtagagacataagtaaacatatcagcattattatgtatacccaattccatattccaactagaaaacatataaagtttatacctcagaaggatacaaaaaaaaaaaaaaaagataatacgaatgtttctgattctagtagtaatgtgttttagttttagtgataaacttttttttttcttaattaactgcaaagctcaaattaataaatatatttcttatatatgaattagttaaagtcttactattctttagatattttgttcaaaaacaataaaacacaatctagattcatagtagttgagtttaatagattgaataaggcgtttcttgaaaataaagataaaaccaaatgaaattatgttacaatgaatcccctccccaaaaaaaaaagtcaatcaatactatatacaaaaggtaatataacactattatgatgggtctagaaaagggtcttggaaagtggggctaaagtttgtaatgataagttgcaactagaatcagcccatccctctctctccttttgttacgagcttattttcaaatcaaggttttagtttctttgtttgaaattagtaacttattttaatagcaagaacagctaaaagttttaccatttctttctttctttttaactaattatcaatctcatatttagttgttttgatttattgttttgcaaataacaatttaactgattgtgtgtgtaagatctaatctgtttaaaacctcgagtagtagttgaaaaaaaagaaaagaaattactaatcaacattaggctttgaatacaatatagacactaaataaaacaactaacaagcaaaccaaaatttatcctccgcttgttatgataagtttcaagaaactatattgtcctgtaattataaggccataaaggaaatagacaatgaaagaaagaaggaaagaaggaaagaaggaagacagttgtccacattgtagagtcattttcattgtcattttcaccaccagggtcaatattgagcatttataatcctctctttcttcgtcaaagtagtatctttttctctcgcttcgcttatgtcatcttgattcaataaattaatccgtaattgacattaacgtaataatagccgtagctgtattatcacataatgtaagtaaaaaaagacaaagagttgtatggttattctttttatttttttgcgtcttgtgaggactttggagatttagactattaaattttgtgttttagggagggcttttgattctaggtctacttgcaattgttacacatggtttttgtttcgattattccaaagtattgagatatttatgaaacgaaacataagaagatatgaagatgagtttacatatacgtatacgcatatttcaaaaaaacaaaagataacgtattgatcataaccactttaactttaatttacgagcaatatataaatatatctataaataggtgctagagatggtgtgttgaggtatttacatatttatagggaaaacaaaaagggggatctacatttgaggctagttagacttagatttaatcttgagaaataagtaactctccacccctccaccacacccctattctattctgtcatttcaacccacactttgaaaaaggataattatatttcctaacattcctttgcgtgtttaccaagagaacaatggaaaagaatgataacaagacgaacggcacggagaatgtggaagaataaaaccaccctccctttcaatatataaatttataaaacagaaaacagaaataaacttattgtattcaaaaaaaaactacttcataacatttgtttttattttaaagtgataatgaaacagactaaattcaaacttgaacttaaatggagatttctttttttttcttttttttggaatttcttttggttattgttgtattcatccctttaattggggattgatagtgaaaaccaaattccaattccaattccaatcacttttaaatatattgttgttaaacaaaacaatatagaagagtagaataaaggaaagaggtggctgtaattctgtttggtgatcatgatgataaggtgtagagagtagtagtagtgcataggtacgataaacttgcatcgaaaatgtgggtatgagacttttttatttaggaattgaaacaatacccaatatcccaaagaaactgggaaaaataataagaaaagttaacattatactactactactactaataataataataattacttacacacacacacatagcaagcacacatatacacaaacttaaaccaatacaaagctttttttatggctgatacaacacacatgcatgcaaagcttggtctcgggagacatacagaaatggaagaaaaagtctatttccgaaattgtttttttttatatatattttcatcaaatcataccgatcgcccacccatgcatgcataaaactatatttttaatgtgtcttggtagttaaggtgaatgaatgagtgaatgttaaccacgcgtcttgtatatatgttgtattattgtttcgtttgtatgttacgtatatgttacgtgtgtgtgtgtatactattattattaatcactatcatcatctatacttttttttttttaaacaataaaatcaaaaatgctctattgtagatgttgtttcttattgttttaaaaaagatgttataattgttttttctaaattttactcaatactatatttctttctttttttttaaaaaaaaaagaaaataaattttatagattaaacaaagacaaatttaaggaatgagaaattttacactaaatgcaattaataatgtgcattattcttattgttggtggaagtggtagtggtgatggtggattgttgatgatatattatatgcattagaaaaaacgaacacaaacgtgttgtatgcataattaattgactaattagttaatatcaatttcttttttttttaaacaatgtaaatcttaacctttttgtttaatttatagttgtagttgttatggttgtagtagtagttgatattgatgttgttgagtcaaaatttaaatttagactagttatttttttaagatattgtcaatttaaccctttgttttggtattttagtagtttaaaaaaagagaataaaatttatttcttgtctatattgtatttgtgatccctctcttaactaaaaactaactaaacccccccaatgccatatattaaatctctcatactcacccttgtgtagtgtagtaaactatattatactatattatacttggtgtgtatatgtgggtgtgtgtcccataaaggaaatgatattaaacatcataaaatacatattattttatttttaaccttttgtgtcatttaactttttttttttttcccactttcttttttcctttttctttttcttttggctcttcgttcccttttcctgttaaaattacactaaagagccaaaagactttttttttttaatataaatatccacaagaattccctgcaagatatctcaaccaccttcaacaaattattttattttatttaattttatttaattattaacaatccttcttttttattacacttgttttccttcatcttttggttttaatatatatatatatatgaataacagcccaactcatattcacttgattaattatacaactcagttcaactcaatgttacaatctccatttacatatacttctagaaagagaagacactctaatgtatcttcatacccaactgtcactactacttccaccactgccaccactttcacttccacttccacttccacttgcacttccactacacattcttcattgaataccaacttaccaacaccaacatcagcaacagctccaataccaagtcccaaacgacaacgcaaatctaaagctgctatgtcggtattaattaataaattatcacaaatgcaatcaaaaattgatcttttacaagattgtggattaaaatgtgaattacaacaattgatagaagaaagtgtacaagaattgaatcaagaacctaaatcaatacatatgaatattcctcagaaatcatttaatgaatttatattaaatactcccaaatcatctacacctttaacattatctacacaatcaacattaataaagtcatgtcgggaggaagttttccatactatagatgatgaagaacataacaatcttatagaaaattatcaaatatttgagactcctaaagagaaaatcataaattatgacaagataactactccaccaagagctccaagacaagaatcattattacctggtttgaattttccaatatttgataaagatgaaattgaatctgctggtttaggtttttgaaataaaaaaagaataatgaattgatgtcatgtcatgtcttgtcttgtcttgtttgcatttgtcacgttttgtttaattgacttaaacaaaataactttcccattcctcccttccccctctcccctctcccctctccccccaacataccatacccttatttttgatgatgatgatgatgataataatgaagctcacagagtatatgaagattgacttttcataatcccagaaaaaaaactattaaaacaagagacaagtaattaatgtttgtatcaatttttttcttcaacaaaaattcaattcaatttaattctatacttaatttcgagagttttgataacccataataataataatgataacaatctacattttctattgtttaaatgctattttcattttagtttgattttgatttcgattctgtttgtctatgtattcctttatagattttttttaactaataaacaatcttttttgtttctactatatgaattgctcttcaaagtcactgctatagagttatgtgacaattggtagtttgaacagtttttgaaaacgataaggtcgtatagcacagttaccttacccaccaatttgatgattctagtaatgtaggacaaagtaataatctgtaatatagcctaaaaaaattataagatatgtagaaagtggaaaaacttcttttggtgtgattttgtaaacttatattaaaatatctcttggttattatttttgttaccaccaaatcatgctctattttgtatcatgatataaaatctttatgaactattgacaaaagcgcaataacagagaattcaccttctctagtgttgattctttcaagatgttatagaatataatttgttatttgtaaaagtgttgttggaccattattgattaattaactccgttttttttcttttattgatatattaagtattcattgtcgtcgtatagtctacgatataactacaaatgcattagatcaccaactaaacaattgatttcttcgcctccttttcctcttcctccccttagaaacgcaaaacctcgccttaagggaataattaacaactaaataataaatcatggcgttgttgttgttgttgttgttgatctggacaaccaatatcttaataataaagcaacgcgtctcctgtgtttgttgttaacccgaaagtaaattgaaatcatgtaataatataaatattatacttttgtggatccccccccaccaggaaccaattggttttttgagtgaatttctgacgtgcgacatcccccacaaaattgatttgacgtccaacaatcacaccctcacttttcaatcagggtagtacatggtgtagtcccttgatggtcccatacgcgtatcatttatttctattttgttggtccctatctaattttttgttgggagagggggttggttgtgaggcactttattatttttcttggacgtgattttagttttcctttttgaattacatcaataattttttcttaataaaaattatcataaataataattgatggtctaaattgtgatggtaaccaacgaacatctaaagaaattgttaattaattgttattgtggttgttgttaagagagaaagaatgtaagtttgagttaattttagacggtgctttttcttcttgttaaattagtgataaattagtttctcataattctctttgttctgataaagtagtaaatgatattgtaacctaatctaacattacttaattgatagtggggttcattatagttaatccttagtgcatattaacataatttgtacaatgataatctaaattgatttactaatttgatttcgattttgattttgatttaattaattttttctttatgaggtgagatggtgacgttgacaactggctttttttataattaaaattccttacacacacatcataattcattcaatttaactctttttggaaatatcaaccaatttaaataaagcatcaacgactactgtcttgccttaagttcaaaaaaataccacgaatctaaccacccaacaaagaccaaatcggatttgataaatcttcccaaaattcccaacacgttattattattattccaaaccattgtttgtggatcaattgttttttagtttaatctggattgtattgtggatcgaaagggggagggtttgggaattggccataatctataagaataattccaacaaaaattttaatgtaaatattaacaagtagtcatgtaatacttctgtggttaaataattctacatacaaaacatgtggaaagggaaaggagggggggtggcaggtgatattgtcccgtgataacataagatttctgaatctatcttgtgctaattgaccaaaaatgttattgtttgactattgatctctggatcaatatcctctaattttttttcgaaactaaaagtacgtatatttacatcactcatttcccaatacagtataaattgtattagtctattctctcttactcacgtttgatttatattttcactgaattataaatgtggggttataagggggcaggatcaaaacatcttattatccgcctctccccttttatttctttttaaagcctcctagtgatattatgttaacattgattacacttaagaaagagtgatagatctaacacaactaagataaaactagtaatgtggtaattgattgaagttttgggaagaacatacatttggtcttcattatacgagagagaaaaagataagcaactactcttaaaatgaatctaaaatgaaaggctgctaatgggttaaagagccaattgccggtcaaacataatacattcttaccttttcaataaatcaacacctaagaattcaacaattgatttaccagcagcaaccacttcttcgtcaaaatacctccgaccagctatttgtaaagcaattggggcaccacaacattcatcaggtttataactatcattttccaattcttccattccacttctatattcatattgtaaatcagattcattccaacgatcaatttcaggatcttgaaataatcctgtttggaaaaccaatgctgggaaatctaataaattataaatcaaagtataagattcattataaactttttctctatgtggagcaacattattataagcaggtccaagaatcacatcaactttgttttccaccataaaatcactatattcttctcttaatgtatctcttaatctattcaattctcgattctcagctacagtataatgtttggctccatcaccaagattcaaataccatttcgtcaacttttttaatggttcccctgattgagaaaataattgacacatcagatgattcccatcagcatttgataacttagtagcacaatcataagctaatttagaattcgttaatggatgtgttgttgtcgttaattcaatgattttggcaccttcattttgcaatttttcaacaacaatatccaatgctcgtctaattggtggggataccctaactacaccatcatctctaacaacagcaatagtcaattgattgatttttggtgggctcatatcacgccaaggaattggtaaacaccacggatcaaaattccagggttttccatcatttatataacttttcatccatagttccaaatcatcaatacttctagcaagtggtcctattacacttggtactgactcttgaccatctgccccaccagctattcctctagcagagattcttcttgtgcttggacgtaatccatgacaaccagaaaatgctgctggagatctaattgatccgccaatatcactaccaactcccaaaacactgccaccaaatgaaacaactgctccttcgccagaggaagatcctccacttgataataataaattatatgggtttttagtaaatccagttatattattccccgaatccaaatgtaaaagcgcttgtggttcattggtacgcatgtagaatactgctcctaactgagataatatttgagtagtgatagcatctttttttggtatattatcaatcatggcaacgtatccaccatgagcaattttacctcttatacaaatatgttctttaagtgtaatgggaataccatgtaaaggcccaactagtttatcatttttttgtaaatattcatctctttcctgggcttgttttagtccttcttcaatgaaaatatctacagcacaattggtgaattggtgggcaatgattgctctcttggcaaatgctttaaatacttcaacagcagtatactctttggatgccatttttttcacaagtaacgtacccggagtatcggttatctcaaattccttctccgatagcaacttttgtgaatataaataatcgacggcattgaattgattgttggttaaaatatccaatgattgtggtaattcaatcaacaatttttgtggtgtagaattggccaagttaagccggtattgttcaaccttgggtaaccagtacttggtgtacttttcagaatcctcataattatcaagaggatcttttgttaataatgaataaaaaagtgagtcagacatgagccaggaggaaaagtattaaatggagtgaattactgatttacattattgtgggggagcagaagtacagcaataaatatagttgaaatattatggagttgaacattccttgttggtacgcaaataacttccatatttggatttcaaaccggttttcttatcgttgaaaagctaaaaaaaattaattgcggaactgttgaaccgcttggttggttggttgtctctgggttaacagttatcataaccttaacttattttgcaatattcattatttccaaaacagctgaacttgatatatatgtattattgctcaaaccataaccataactaaagaaataatagaaaaatctggtcatcacaaagatatatgtcttcctttgataaaagcaggaacgagatcaaaataattcagcagtgaaacgatcacacaatgaagcaaagggaaaaaaaaaaacaataaaaattttttttttctcttaagcacttggaagtgatttcattatatcaacaagcccccgacgtcccccagagaaatggattttgaaacaagagaagacaatgatggggttagactctcgtggacttctttacccaaatccaaattacaacatcaaagaaatgttatccctatgggtgcattatatactcctttaaacaacaaaacatcaatctccgttctagaccaaaattgtattattagttgtcgaacatgtcgagcagtattaaatccttattcacctataaataactcactttggacatgtcaaatatgtaattcatctaatcaactcccagcaatggttgactctgaaggtcagccatgttaccctcccaatctcaatccagaattaacaacagtagagtataaaactggtagatcaagtgctttacctccaatatttttttatgttgtcgataccatatttgaaaatgatgatattgaaagtgctttccaacaacttaaagaaagtttaacagtgtctttgagtcttttaccagaagatgcattagttgggttcatctcgtttggtaaacatgtgagaatacatgatttgggtagcaatgacaatttaagttacacatttaacgggaacaaacagtacacattggaacaacttcaatcttcccttggattaatgagttccggattgagcactgctgggttaaaacaagctaaagataataatgggtatgatcaattgattggtaatataggtaaaagattcttacagccagtaaatattgccgaatatcaattgacaagaattatagaaaccttggtaccggatagatttcctcataatgaatatagtgaacgtccagaaagagccactggtgcagcaataaatgttgcttcgttattgctaaaaaccattttaaataatctgcatcatttgactggtggtcatttaatggtgtttatcagtggtgtatgtacttttggaccaggcaaaattgttgataaattgttaaaagaaccactcagatcccatcatgacattataaaagcgcaaacaactaccatacaaactccatcgacatctcatgttgccaaaagtgatattaatttattcaaacaagcaaaaaaattttatgaaggaataactaaaactcttgttacgttggggcttagttgtgattttttcattggaagttatgatcaagtgggactttatgaaatggatgaagtatgctataaaacaggtggtagtgttgttttaagtgattcttttagtactgccattttcaaacaaagttttataagatttttcaaaaagcaagaagaagacgaacaagatggagaaaattctgaatatttggatatggggttcaatgccactttagaagttaagactggagttgatttgaaaattgaagggcttattgggaatgcaacatcgttaccttttaataaaactgttcctgctaatgaaagaatgataagtaccaatattgttggagaggggaaaaccaacagttggaaattgtgcaatgccaatccacaatcaacttatgcattatattttgagaaactagatagtgttgctgctgctacaacaatacagtttcttttccattatcaacatccatcaggtgagatgagattacgtgtcacgacaattcctgtaaatattattgctgattccgataacatcaacttggaattagggtttgatcaagaaactgcactagttttggttgcccgtgactcaataaataagttacaaccaggaaatacaaaagtggcaacaacagctagtattgtcaaacaattggacaatacattgattgatttttgtactcgttttgcagtttatactgctggtcagattgaatcttttagattggcacagacattttctttattcccccaatttctttaccacttaagacgatcaccatttataaatgttttcaacagctcacctgatgaaaccagttatgttagacatgtgtttatgcacgaagacaccgcaaactcattattaatgatacaaccaacattattgtcctatgatgtaaatacatgggggtcgttagttgatgaaaccactggtgaaacaataaatgaacctgaaccagtattattggactcattgagtttaggacgatccaaaatattgttgttggatacatttttccaaattttaatttatcatggagctcaggttgctgaatggagaaaagctggatatcatgaacaagaggaatatcaatatttcaaagaattcttggaagctccgaaaagggaagcaatgatgctattaatggatagattccccttgcctagattcattgattgtgatgaaggtggatctcaggcaagatttttaatggccaagttgaaccctagtacaagctatgctacaaatgtcaatcatctttatggtattggagaccgaagtgacgttttcaccgatgataccaacttacaactgtttatggatcatatacaaagagtagttacagctaaaaaatagacaattgcatttatataataataacaaaatagcatttatttacctttggctctagcagccacaattgctctttttaagaactgacttctagctggttgttgtccttgtgagtcttgatctatatccatgatagaatcatctgctgaacgaagttgttctacttcttctgccttttttaatgtgaattttgtgttattattgcaagtcaaatgttccttaaccttgcctataaattgaccattttcatcaaatattagttcagtaccttgtaattgattccaatcagtctgataaattttcccatctataagtgctgatggatcaatgactcctgaattgtgagtatgactattaaatccatttttcgacgctgataacgacgacgacgacgagccttgagcagatatagtattgttcgatatttttactaatggatgatcttcttttaaatcagtaaattggagttgtgctgaaggcttgataatattgtttttgaattttggagcttgacctgtccttgatggtggttcttcttcattgtcgattttattcgaaattgaaggtatatcgatggttacataaaatgtctaaaaacacatgtgttagtatttcattttgaactatttttatttttaaacaaaaaagtgaatcaagaaattcaaaacgtttgtatctctatattttctaagtttgtgtctatttaatatctctttcaagttttacgtacttcaaattcatcttcattcccatctatttctgccccagtggcagattcagtgatgggaccatcggatttggtttgttcatttttcttcaatgcttttgcttctgcttctgctgctgcctttctttgcgctatatcttcagctgacccggcttcaacaccacgacggaaatcccagttcatttcttcaccctgtgtcaagaattcacaattaccattcatgacaattttccattgaatagtatgattggttttatcttcgccatctctaacaaatttggataatgaacatgcaccagcacgtaacacagtttgattatcatctataacatcagtaactgattttaactgtaataaagctgatcctaaagcaattttcgttgctgcatgtgtaactatcaacacatttttaatttcggggaatttcttttcaaattcaggaataaactttttccaaaacaatttggcacgatcgtagatttcatcataatcttctccttcaatattaggtataacatttaagttatctcttggccaagtatcttcatcgatcaataatttatcgaaaaatgttctcaattgtgtgtaatcaccgggaactggtttggtatctctatttttacgaaaccattcaccaactcctctttctaaagcaatcttcaagtccaacatttcggcaatgggtctcgacgtttctatacaacgataaaaaggtgaagcaataataaattcaggcttttcatgtgtaggtaatgatgtaagataggcagctaactgttgggcttgttcaacaccatgtggtgctaaagccgggtcactgtcaataccagtaggatttggtgggtgtggtggtggtaaccaattggatctataaccgtgtcttgcgatataaatagtttcaatcgtcatatttgtgagtagaaaggtaatctattgatatgtatataaaagaataaagcaatcttgtaacaaacaactagtagtaaagaagaagaagaagaaaaaaatagaacgatgagagtttgattgatgtttgagtgaggaattggtcttctttatttatgtttcatttttctgttgttgttgttgttgtgaatttgtcataataattttgcgactcaccagttacgcaatgtgtgattcaactatcattaacatcacgatactgtcaagttgacaacaattactcgagacaagcttgtctttcaatgctaattataacactttggtatatactaaaaagtttactgtacattatttgagtcttctttcgaatactctttttttcatttatcttatatccacttttgttctcctaactagcctaacctaaacgtatttagatcaacatttctaatggattttcgacaattctcttcaattctttcatccattcaccaccaagggcaccatcaataactctgtgatcaaaagtaccagtaatagtgataacatcatcaaacacaaatccttgttcgttaacttcacttggaacagctttcttttcggtagtaccaatggcaaggatggcagattgtggtgggttgataatagatgtgaaagcagtaacagcatggttcatacccaagttggaaatacagatggtaccaccttggaattcttctggaagtaatttaccaaccttggctctcttacccaaatctttgacttggttagaaatttcagccaatcctttagattcagcattagtgacaattggagtgatcaatccagttggggtggcaacagcgacagaaacatcaacattcttgtattgtctgataacaccttgttcacctaaccaagcagcatttacttctggaattctgacacaggtcttagcaatagccttgattaataaatcgttgatagacaacttgtatctttcttcagcagtggcattcaatgaagcacgtaatttcaataatttagacacggaaatttgagattgaataatgtatgatggggattgttgagtagattgtaataatctggaagcaattgtctttctcatagaagtgattgggatatcttcgtaggaagcagtagcacttggagcagcaccggcggtggcggcggcggcagctggagcagcagcagcagcagcttgtggttcaacaccttcgagatctttggcaacaattctaccatttggaccagaacctttaatacctttcaaggaaatacctttttctaaagcaatagttttagcaaatggtgatgcaattattctgtcggttggggcttttttagaagatggggatggagtagaagctggagctgaagtggaggtagaagcctttggttcttctttctttggtgcttcttcttcagcagcaggtgctggttttggtgcttctccggcatcagcagcagtgaaattttcaaatgctgcaacttcaccggcatcttcaacataaacagcaattggttgtccaactggaacgtctttagcaccagcatccaataaaatcttggccaaataaccttcttcttgaaattcaaaatccattgatgctttatcggtttcaatttcggcgattgcttcaccaggtgttaactcatcgccaacttttttggcccaagattgaatgttaccttgagtcatggttggagataatgctggcatattgataacagtatgtggtgggaatttacctgaagaatataatcttgccaatgctaagaatgatgaagtggtggcagtagaacttcttggagcaatgctacgaagagcaattgctgatctcgaaacggcaaataaagcagacattataattcaatgaatctgaataggttgatagtagtgaataattataaagttgttctattcaagggaaagaaaagaaaagaaagaaaaaaatggctactgatttaagttctttttgtttaatctgcgatgtgtgtgtctctatgatgagaaaacagtttgtttctttgtttgtttgcctgtctaagttgtctttttttttccgagttttttaattttttacttcaccaatttgtcgttgttttgcggtgttcaatggattgatcttgtccgctgcgagaaacaattgcccatacacttcggacttttatttccgtgtatacaaaatatatattatattatattatattatattatattattgttacatatgtagaacactatttctagtactctctataataagtttacattactactactacaaaagtagttccttttaagcttactattatctttctttttatctatcatagcaaacacatcttgatagcctttttctacccccttaccttgatcttcataaacaacttctgcggcattgtttttaaccaaactatcttttgccgtttgccatgaaaatctaataaagccatagcaccaaccaaacactggatcaacgttggaattgagccatttgctggtgttagggtcactgggataacctgaacccaatttttggccttgtaaaagtggcaagttttcattatagaactttatgtttgtatctcttgtgactttagcaacaacagaggctgtactcactattgggtaaatgctatcggcttttttcgttactgtgacatcaatttctgggaagaatctttttagtttggcttgatacgttactggcggacccacagtatcgacaaatattttcgatatctttacacctttagctaatacttgtttgatcaagttaatagtagtatcatgtgcttgttcattcaaattgtaagctcctttaccatttactgactgtaacataccactagaaatgtctctagcggtcatcgttgtggtagcccatccaatgtgtttatgcaattcatgatctggatcctcaatttgcttgaataattcttctcttttcacatctgtcaatactttggaatcagcaaagccatattctttttgaagtttggacagaaatgattctagagaatatgcaatcccatacaccatgggacccaatactggtcctctcccagcttcgtcaacaccaagtacaattggttcagtcttgttttgtagaatactttgaggaatttctgaatgataagtagaacttgcaaatttgaatggatcttcaatattggtcacggatggtggtagccaatctaatgaaattgcaagtttggatctcttatttgtatcactttctgttgcttctactgactctgttgttgttggggtatcttcagtaacttcatcaacctttctcttgagggatgcatcaagtaatactgtatctggagattccaatgctattgcagatgccatgttatcaaacttttctatataacttccacaaaaaaaagaactaggaacaagatctgataaatctatttgaaaaaaaagtttttgtgggagaaaggaatgaggaatcaaagtaaacaaacaagctggagatgtcgcgcgaaaacattcaacacgcgtcggcccaagtaatggctgaacagagaagtacattaaaatgtttcattgaagaacatttcaaaagctgatttctatgtatttttctgtttttattaaatggtattatgtttataagtggatgaggaggctatggttttgttaattaggcgctttttaaactattacttgattgtctcattttttgacaaaatttgttggaaaactgcaaccaaattttcatgccaaacaactttagtcagaaatttctatcaactgccttataacttgtgattaacaccacagtattgtacatttctagaagctatagtatcaaaaagcggaacttactagcactacatacaactggtggtgatgatcacacaaatagattgacaaagctcgtcattgaatggaatgcctaacattgacttctcgtctaaacaatagatgcggcacaaaattattaatagaataaacaaaccgagaactcaaataataataatagtgaaactgcaaagagaaaacttcattgtaacagtatactttccttaaaacattaaaacacatttgaaacatttcatatttttcatggctgattaagattgcgtgaataaaatcattggtgttgtgacagatttttttcttagggtggtgctaatttatctttactctatcgcagattacgaacacttccccccgtcttcccagttcagttcaatcaagctatatatcacttttgtgtttagttagtttcaaagagtataagatgttttaaattgaaagatcatagggaaggccatttttttttatcgttgtctgttttagtttattaagtaagattttatttttagtttaagaaaacaaaaacaaaaacaaccacagcatctcaaaactaaacttcttggtactaccactaatttttttttattgccattccctttctgttttggtgttgttgcatcaaatcaataaatctgttctagtttcaccttttcccatcacattcatttaattttttggatatttcattcatttaatattgataacactcaacaaatcacaacagcctatccaaaatataacattgacacatacacttttttttttcccacatcttttgatagatctgagtactccccgtcaaacacactcttgggaaataggagaatagaaatataacatcctattacagcaacagaactacaaccccccccattcattcaaaaactaccaaaacaacccacagaaacatgggttccaaaaacaaacgatatagctatttaccagcatcaaagaatgatcatttcaatgcagaaaatgagattaaaaaataccatttagatgtatcaacatttgatgttataagagtgaataatttccgtaattacaactgttcgactttgttttggtatttttacatgtgggttctaatctttttatcatttgcattattagcaacagatatctattcttgtctaaatatccttgtattccatagatgggctagtgatgattacaagccgtacgcatattccattgccaaatggattttcactggatgtataatatttcagtttgtgctactattttatcattggatatgggccatacatattgccaggacaagaaatattgccttggtttatctaaattccatagccaaaagactctatctgataaaatattatgataatttttgtttattaaacagtatcaacgaaggtcatttttttgattggtgttgttttttaacttattatgagatagataatgcattacaaatattagtggctgacaccccaagacaagttatcaatatattgacattaagatactatgccactggtggagagttaaataacaatattttgaataacattgaacaaattgccaatacaaatttgtacttgtctattattttgagtttcatgtgtttatcggtgttcatctatgctatattcttcttgaggtttgtatttgggatgctttgttacattccattaaagatccaattgagcaacgatggctataagagttttaaagattactgttgtcacttgattaacgaaagtattgctgatgcagttaggttgcaccataaaccaaagaaagtgttgttggagcaaggtatattatcggaagagagaattgctcaattgcctgtgttggaagatcgtccacctcgttataatgactactcaaaaactttttaccgtacagataccagtgccacattggaatcaaatattccattgaattatatgaaagatagatcaaattccaccaataattccagagacgattttggaggccacagtaaccaaaaagtatattcacccattaatgatcaaaataatggaattgggaaacgtctaagtcaattgagagagaagtatactcaaccaagttatggtgtaatagagaaatctaaaccagttgattcgatagtaggtcacgaacaactgctttacaagtcgagacaaagatcacaagcttcgcttttgagtgaggatcaaaacgaattaatgtacaaacaaccacgatcaacaagcttgacacatgacacatcaagaacccacttgaacaacccaccaaaacggtctatcactgacatttcagaacaaattggtcagcagaatctaccatcttcctttaagccaatgagaaaagctcctactgcaccattagggcgtgagagtcaccagaacagtcaagacataaattctttaactggatatgaccaaccagtacagcccttaccaaagtcatacacacaagatcatccacatagacacaagtataatgattatgccgaactgataacgaacccctttgggaatccaagctcaatatattcaggatcagtggatgatttttcaagaccgatgaaaacagattatacagatgagggtataaatccgttatacagccagattaaaccattgaaaaaatcaacaacggaacctattaattcatttgaactctcatatcagactccacctgaaaccaagttcaagcgttcgttcactgatgagtatccaataactgaagaggatagattacattcctcacaagacgaaagtaaagtgaacaatcaagaagaggaccaacaacagggtagtcctacaggaactgatattatagatgactttttagaagaattgaatgccccaccagaaaaagaacctccttatccagtaagaggagtttcgaaatactttgaaacttagtgaaaactagacaagaaaatggacgtagtgatagacttattttatagaatgaaaggttttaatgcatagaaaaatgtcacattccttatttatagtagataaacaaaaatattttaaacacacatacatgtttttactcaaaaaatacaggcttaaacaatattgatagcatatgtacaagaacccacgaacctaattcattcaacttttccctcatgtcatcatcatgactatttttggttttcgtattccaatttcaacttttgtaattcttcatcactgattggtggaatagggatatcaccaagatcatcatctcccattttcttaaatgtatacaagtacacagctaacggtatactactgacggcaaataaagcaatagtatttctccagaaaaatggagctcttactctgtacaaggctggcgtgatttgatgagtttttggatctctgtaacgatcatgcccttttcttgataacaaaggatgttagtatcaaatgctatcattgtttcaagaaaattggaatttttttttacttacggtgctcctactaatttacccatagctaatgattataatgtggttgtttgattaatactgatgtttgttgttgaaatgttacgatctagctttgtattttttttttcttccctgttttaacaatcacgctgttttatgagtggactttgaaaatgtatatgcagtattttgtccaaacaacaatacaaacatcgagtatatgttgatagcataagaatttatgctcctcattaatctgtaattaatacttcgtaaaaatagcattggctgtaacataaagagagtagaataaatatacatacaggttttattaccggttttctagattatatacaagaacctaaactatttaatgtcttttgatgaacccttgattcacgctatcttttcttctttgagtagcttccaattttttattagtttctctagcttgtttaatagatttttctttactatcgtcaacaaatttgctcaccatatctttaatagattggtttgctttaggattattggcttgcatttctgcaagactcaatttaggaggcataccagcaattttcctaaaccaactacttttgaacaaactactttggataagggaaaatatcgagttaacagcaaaatacaaaataatagcagatgcaaaccctttagtaatgaaaatagaagcaattggaacaacagtcatgacttttttcatacctgctgccatggcatgttgaccagtttcaccacccactctaacaacagcaatgatggcagcagcagaaatagcttgtaatcccaaatatggatcaacttcaatcaaattttgaaaccaagcatacccttgatcagaaaacccttcaacattatgattagccatttttctcaaagcttggaaaaacccatatgccaatggtaattggacggcaggaaataaagtggctaatgtggaaacaccattttctttcataataagtcttcttttttccatagctctcatttggtcaactgtatcaccagtcttaatttgttgtaataattcgtcaatttgtggttttattttagacatcttagttgcattagatgatgctctgacatataatggaaacaaaacaagtctaacagcaatggtagcaacaacaatagtaccccaccatggtaacccagtataaacatgagtaacttctaataatctttcaatcaaacttgttggtccccaaccttgagctagaccgatggattgcaaatatcccaattgatcagaatgtaaatttgtaacattttcaagtatagcagaagtggtggtatcatcaaatgaagtcaatttatcttggatttcagtcccactagttgttgtcgatgaattgaatctgattgatgagtatattaaaggtgaccgggtggctatgttagagggaattccaaccctaacggttttcaaagatgctgaagttgctctaaatgagcgggtcaaccctaatctaagcattatgggtggtattatagttatagtaatagttcttagatttacagtttgatcaaaaaaatgaaaaaaaaaaaaaataaaaaagaattattgttgaaaaatttcaaaagtcgtgtctggtcttacacattattgattgagtgtttcttttaaagaaaagtctttttctcaaccaatgttatataaggtgatttggtttattgacaggatcaactcatagaatgaatattgggcgtcgaatacgaccgaggaaactacatttgagattatattctcaagtgaaagttccgtggtcattggaaactccaataactcctaaaacagttacagatattttacctcattttgttcaattaccaattgaagaacaagatacattaattgaaaaacatcctaaattactcaatgtacaattacaaataatgctatattctgaactggatagtttgaagacattcaaatttatttgtaagtacggtcaacatttgcaatcagaatttattcagatatttatttacaatttacttttatcaaataacctcaaggcaacaactacattattgcatcagcttttacacgaaaataaagagtttcaaatgtcaaatgaattatgggcattatatatggataaagtttgttatatgggggattatcttggggcaacaatgatatatcatgaattagttgataacgtaaagttttatgaagaaacaagttatttagtacaaacaaataatctaatgccattcttgatcaatgaatctaccttggtagctttagcatatatatttagaaacaacaaagacgcgtcacgagttggtggcataatacagtattttcgtcgattttattcatttttacgttcacaatatatttacaagtctttattgattttgcaaattgaatcatatgctgaacttggagacctagaacaatgtttaaaattatttacagcttttggatttaatcataatcaaagtgatgtaaaaagaaacaggaatgtgcaagcaggatgggagaatatacacaaacgacatgaagccatccaaaccaatgagaatccattattatacaaggattcaaaatatgatttggatattcaccagaatttattagctgaaatttgtaataccgagttatttaatcctatcattcatagaaatgtctattcttcatctaaaactggacacaacccagttatcaatggatctatatctgtcaatgatttgccagctttggaaacgttaatcactgaaaaagtggctaccatggaaatgagggaattattacatctaacaaaaatgtctcatcaatcaattaatcttttcatagttgctggattatgcaatgtcaataaaccacatatggcacttcagtatttgaaaacattatcacatattttccccactatatcaaggaaaaatcttataaagaatcaaaattttattcgtattttacatgctacacaagatgtggaactcgccaaggaagtgatgaactattatcgtgatatccataatgactacattaatgttcaagtgttacaagcgtaaatacttgttttgttgtctaatgaattcactacagtttcagatctcatccctagcttacaattgcttgaatcttaccaagatgttaaattgtttgtcaatcctgatcaatacgaaaaattttgtaaattaaccaaaaataccaaaaattatgactttattcatgtacatagttaaaataaaaacttaaatgaaaactaaactgaaatgaaatataatataataatactaccacatacttttaaacgtcaagttcgtttttttacctcattattcctctctaggggcagacattttgtgaattttcactcctttatcatttaattctccaacaacagcaatatcctgaggagtaataaaaatattctgtgattttggatatctctttaattctttcaataacaatttaatactaatagaacgattcactgaatccatataaacatcaaactcatctaaacctctaatacgagaattcatcactttccaaatagataacaataaggcaatttgtgaaaatgatttttcaccaccagataatgattccacggtacgtttcttttcatcgttaccagtttgtacattcaattgtaatgttttttcggcaaaatcaaatttcaaagtaccttggaatcctcttaaccacatggctttttcaaaagttctttttgcctcttgaattgaagattggattatagtatgtaagaaattgaatctagcattaacttctgcatttaattttcttgatgcagaactcaaagattctaattccccctcggctttgtcacattttgcctttgctttttctagttggtccaagacttcttccaatgaagttccaagagcactttctgctctttccaaatcaaaacgagtctcttgataatcttgtgctatcgtctcttgggtatcattagggtatatggtaactctatctctgctacaatgttcttcagctttggcaacaaattcttccaatttacgattcccttcagcaagtatatcgtcagctcttttgattctatcttccaattcagttatcttgtataaataacgttttttaaggtcctcttgggtttcaatttcagtttcaatctcaactaactgtttcacaaatttttctcgaatggtttcatgtttaacttttttggatttgcaatcttcaatttgttgtttcaaatccttataattttcattcatctgagaaagattttctaataatgcttcgttcaaagcaaccaatctacggatttgttcattattgtcttctattcttgcttccaatgtggtgatatttgaataatcaacttcaacttccaattgatcctctaaagtactacgatttcttttcaattgatctaaatttctcttgatggcacgagattcagatacaagattatctctcttggcatccaatttcatttttatacttctggcccgtctttctaaatcattttgatgtctatgttcttcatccaattcacgttgtagatcactgatcaaatctgacatattagcgaccccaaacttggccattccattttggtagtatataggatcttgtctaaaggtgttgttttgataactcattctatgaccggaatcctttctgaaaagaactaaagaattttggacatttcttctcctgcatgaatctctagcttcactggcagattctactataacatttttttcaatggaatttatatcaatcaaagcatacaaaatcgtatcattttccacatttaacatgtctaaaacagtggtgaatgcagaatctgctttaccggaagcatagttcaatctttctgttttcttgacaataatgttgctacgtatttgatattgcttgagtaatctgtccaacctacttctatcaccttcattggtaacaataaatgaatccaaggttttattcaaaatggtagataacaaaggtttccaattattgtattgattctttacatgaatatagctaccaataggaccgattggctcttgcacccaatcaggatgtcttttaatcgcttttatcaattcagccatacgagaaccccaaggcgaatattttgatacagactctttctctaattgacgcttttggttttgtaaatcggcaattttctgtcttgatttctccctttgttgacttacagatctcaactcgggatcaggattatcttgcatttccacaagttgttttttcaaattttccaattgactttccaactcatcaatttcagagtttaacttttccaattcttcagccattttctccttgtttcccccttgtagttcttgaattcttcttctctcctgttctatcttagtctcggtcctagtaatatcttctttcaaactattcatttcatcaatattctttttcgtttcctttttattgatttctaactcagatttcatctcagatcttttgcttcgaagtccctcaaattcttccactatatcttttatttggctttccacttccttaacttgctgatcagcagcatcctttcgaggaatttttgcttcaatttctttttcacaaacatcaatctggtttttggcctgctcaatttcttgcaagcaagtgtctttttgtcgattttcttgatcaatttttttctcgatggtttgaacattgaaccaatagattttggcattcaacatttccaatttgtttcttaatgcatcattagttctatgcgcattatgaactttggcaattgctttgtattcttgtttagccaccttggtgtattcttcagcttgacggactttattatccaacacttggacattgttggaaatacttgtatagttttcaaggatatcagtgataaatgccccatccataaaatattcatacttgtttttatcactcgatgatgttaagaattctctagctttgtcttgagacaagaaggcgagtggattatcaatggtgatagaaaacttgtaaagaatctcatccaaaacactctttttgtttgacactacttttcctgcttcatttttaatgctgtatgtattggaaccagatctttgtaattttctttcaataatgattttcttcccgaaaacgtctggtttatacgcgtctgacccttcatttttgagaaccactgtgattcgagaagtagatttcccatctttgattaaatctctgatagtgcttcctctatttgtatcagttgctttggcacctaaccctacagatataccagttaagattgcactctttcctgacccatttcttccaataataaaattcaactggggtcccaatttcaattcaaatgaatcgtggcacataaagttctttaaagttaatttctcaataacccccgctttagccggatctgaaccaacgtcatcatcatcatcctcctcctcatcatcatcgtcgtcgtcctcatcgtcttcatcatcatctgattccccgtcagaatccgaatcagcacctgaaatagattcagtttctgatgcactttcacgtccatttctactaggggcttgagtcattgttcttcgttttctgggttgatcagatgagttaatcaatagttgtgacatatattctgacacgccttcaccaccatttctggcatcgaataaagaatccgcgtcatgtttccttttatacggtacagtcatttggataatattcaaagtaacataaaaatataataccacttatacaccaaagaagtttaatagagtgtagatttgttgctgttgtagataatttgattgattttttggggtgttcgtgtttaacttttgggattcaattgttttctgaaatcaaaagaagaaaagaaaaaaatttcgtgaacaaccaaaaaaaaaaaagaaaagaaagcgcttcaaacgagtcgcgtctcaattaccaaaaaaaaagataaaaaaattgtttgaacgtgacaagacacgatatgccctgcttacataatcaaaaagtttattaacttcttttcagagaaaaattatcaaagcaaaggctgcattatgcttgatgcaaatacagggagcatactgctgttaagagggtttttttttttggtagtggtagtggtaataataatgatgttggttggaaatataataaatttcacaagacaacttactacttcttggtggggggaaggaccaactaatattttttctctcttattgttgttgatgttggttgttgatgaacaaacaaaaagaggttccatctctctcactttgcaactatctcttgtatcttaaaccctatactaacagagagagaagaaaaaaaagtttagtttataagcatctttcagtcacttttttctttacccactactactgaatggtctaatattccattaagatgataaccttgttaatatttatttttgcatttttgggaaatgtcttatgttacccacaagccattctttctcatcaaatatctcccaaagtgatgatagtatcaatgtttcagccagaggaagaggcatggacttcaaaagttgattttcaacacaacatcactgttccaggtttacatccattatatccaaatgttcattgtacttccaattttgatatttgtcaatttaccactggggaaggagaaataaatgctgccagttcaatagcatttttaatttcaaattcaaaatttgatttctcaaaaacttattggttgttagcaggaattggcggtggtgatcctgctaaagtaaccactggatcagtgacatttgcaaaatatgctatacaagttggtttacaatatcaaatagattctcgagaattaactaacacgaatcataaagaaggttggacttctggatattttagttatggaacaaaacatcctcaagattaccctgattcggtttatggtactgaagtttttgaagtgaatgagaaattaagagatagagccatggaattatctcgtaagaatgaaaaattgttaaaactcggtgatgacgataatgttagtttaagaaagttgtattcaagtcctgccaataaaatccccaccattttagcttgtgatgttttgactagtgataattattttaccggacatgttttgaacgattattttagtagttattcccagttgattaccaatagttcagcaaattattgttcgagtgcccaagaagaaaatgctactttggaatcgtttattagagttgccaaaaatggcttgattgattatgaaagaattgttattttgagaacaatttctaattttgttgccaaacctaaagatttatcaattgatccaattgagtttttcaatgaatatcctaaaggtggtattcaacatgcattggataatttgtatattggtggttggccatttgttgaagatgtcgtcaataattgggatagtttatacaaagatggtcaatcttttagagcagagaattatttaggtgatatcttaaacactcttgacggtcaaggtaaagattttggtaaagattcttatcacatcagttgataccagatttaataattaaacttactacagacacatataagtaacatactaacagattttgatagaaacggtcattctaatcacaactaataaattatagaagtcaaaaaaattgtctaatttttcatatattgattaattaaacagaacagaatataatgaaacctacttttgtatcgtttactcaaacggttcatttagtaaacaaattgagatgagacctaaaaagtttcacaaactaaaatggtcctacaaatcatcacaattacactaagaacagtacaataccgttacattttaaatgtatactaagttgacttcttttatcttgttcctaataatatttaatttctttatctatttgatgccgtgcctgctttttaataataggtgacaaacttccgatgcatttccccgaaagtgagaagttttgccgttccattggaaaatcggaacattctttcagcagcaacaaaaacaacaatagtttatcagttttcctatttgggaacaaagctattacgatttgttttaatttatcattatcaacgagtttaaagttacagtaatttatttactaaaaagataaaggaaattacccatttaatacaatgaaatgaaactcggggcacaataataaatccaattaattatcacaatgtacctcatcttaattctcttcactgctctgctctttctttttgattgcacattagatgataaatacacacacacatatatatatataaatagatctacaaatctcttctattaaacttttcagtttcaaaaagaaaacaacagcttttgtttttgcaattgtattcccccctccgcccaaatatcatcatgaagttatccactttatttacattagccacaaccatttctacattgactacttttaccattgccagtcccgtagtagtagtggagaaaagagccattaatgaaactgcattagctgaagatatcccaaccaccaaaaacaatcatgctcaaacatcatatgggaaaccatttgccatttatcaaccaaaagcatttattatttccatgtttagtttagaaagagatccttggttaaaggctatggattttgttcataatattaccataccgggattatcaccagtttatcccgatattcattgtacaacaaattataccatttgtcaaatcactactggagaaggtgaaattaatgctgctagttcaatttcagcattaactttaaatccattatttgatttaacgaaaacttattttttagttggtggaatcgctggtggtgaaccaaattatactaccattggtggagttacatttgctaaatatgccgttcaagttggattagaatatcaattggcttatgaagattatcataaaactaatcctgattggatttccggttatattccatatggtactgatgatcaaaatacttatcctggtaatgtatatggtacagaagtatttgaagttaatgaaaaattaagagatagagccgttgaattagcttctaaagttcatttaaataatggtactgaaggtaatgctaaatttagaaaattatataatgaaactgctgctcaaggattacctaaagttgttaaatgtgattctttaactagtgataattatttcactggtaatgtattaaatgattattttgctaatttcacattattgatgactaatggttctgctacttattgttctacagctcaagaagataatgctactttagaagtcatgacaagattggctaaacatggcttggttgattatgatagaatcatgatcatgagaactatttctgatttttcaagaccacctccatcaatgtcagcttatgaatatttctttaatagaagtgatggtgggatttctgcaagtttagaaaatttggttattgctggtactccaattattcatgatatcgttcaaaattgggataaaatttatgaaagtggtgaaaaatattcttctaaaaattatgttggtgatatctttgccactttgggtggtaaaccagatttcggtaaagaatcatttgatactgcttaattaataccccctccatgttctcttccccacaaaaggttaaatcaactttttcacgttgtcttacatttctactatattctttattgtaaaacatttctaaaaaatattcgtatatatatatatatatatgtatgtataaattatattatcattatcactttctataaatacaaaagtgagctttagaaaatcacattttatattcaaaattgaactttaagctcctcttctttaccaaaaccttgaccaatgaaattttgattgggttttgtaactgtcttatcggttcttgtagtgtcatcggaaactactttcgtaagatgatgaacaccatcatcatttgggtcaacaccactttggataacattgttcttgcgtggggtgttattgttatcttgtccaagtcccagctgttgttgttgttgatattgtctttctcccaatttcagatccacctttacatcaacatgttcatgctgatgcttaataccaaagtcatactcttgtttttgtttttgttcgtgtttgttctcttgttcacgttcaagttcgtgttgacgttcgtgttgacgttcgtgttgacgttcgtgttgacgttcgtgttgacgttcgtgttcgcgttcttgttcacgttgaggttcacgttggggttcacattctggtttgacttgaatttgaatatgatgttcatgttcaggttcttgttcatattgatgattttgctgttgctcttgttgttgactttcaatctcggtttctgaattttgtccctgcgcgtgatttaaatccgattcaatgtctttcttttcatcttctctatcatcaaatacttcgtgataattattaatcaatttttctaaaaccaaattcataaacccaaaattattaatcaaaatatccaaattactagattctgttaatgctggccctatcaccgtagcaatatttgatggtgtcattttattaacttctttatgttcactgattttattcaaatgctttaccaaaatttttaaagtgttgaaattgaccactggtaatgaatgtaaaattttttgataagcattcaaatcaaatgcatcacgatctggggtttggtttttattttcttgttccaacttcaattcataaaattgactaatagcatcatcagttattaatgaatctggtaattcacggaaataggatttgacaatactggtcaaagcatgagtatcatatccccgatcattgaaattgatagtacctgttctatcaatcgtttgtttaatactagtcaactcactaatggaagaactgatacgataaataccaacatctttgattccttcggattcaatttcttggaatatggcttccaaaaatttcggaacaacagataattctctaacacaaataaaactaattggaacgccaaagacaagattattgtttgtagttttgttgttaagaatacgtgaataaaaccaatgtctattagcgtaatttaatttaattaaccattcattcaagtcagtgtcatttgtagcttggaaaaaataatgatcattagttgtttcagaatcaattttaaaacacaatggcataaggtatacagggaaaatctttctgttttttaaaggtatcacaacaactggcttttgctttggttcgatcgaatcttctggatttggtaattcttcaatattaacaactctttctggagtggatgtgtttccagttaaagaaaatggccttgatttggtaaataatccacttattttgaatctagatgatgagcttgatttgtatgataatgattgacgtttcaaagatgtatttgatgtttttctcgtcaaattgtgcattccacttaatgcattattattgttgttgttgttgaagttgttgttattgttattgttattgttattggtattgccggcagcagtggtagtgttgctagtgctggcactaattccactatgaacattactgaaactgctattggtggcagaacgaatagataaattgtttgtacccttaatgagtcttttagaatctctaatatgtttcttttgattatcaacaactaaaatttgatgttgatctttcataattctttggaaaatttcagctttgtcaacaggagaaaattctctaagattttgttgattcactaatgattcatccaatttcaataaaaagtcaaactcacgagattcattaaaagtgaaatcattagaacccgattcaccttcaaaatcttccacacttaattccctaatcaacttataaatcaaatatctcttgttaaaattgatttgatttttaaaataggaaggacatttatcagtttcaatcaaattctcaatgatccatccaaaacatggcaataatggctcagtcgattgtaaatcattgatagtgatatttggtggcaataacagttcaacgctatcaaaattcccttcacgatgggttaatgtttgagctgcccttacccataaattcgaaaatttacgactctcgggggaataaatcacattaataattgctgtctcaatacatgatggaatattaccactaccttcaaaaataaattgattatcactcatttttaatttcgatacttcagccattatcaataatgttttcattctatctaatctttcatcagtggttatgttcaaatcagtcaattgcaccaacaaataacttttgaatttaaagtacactttgaacaatttacggaaaacaagtgggaattttttcaacaacaattgacgttcatctggaatgactaaagattcaaaaaaattgaatatattggaaattattaattgatcatccagtactgtaggtttttgtaaactgaaatctaacaaggcattcttttcaaatgagttttccaaaatcttgtataccctaacccaatcttcagtttttattcccttgtaaaacacagctaataatttgttgaatttatacaaaaacttttcaattttatgaacatttctatgacttggcaaatttctattcatgggcacttcgtgaagtgaattgttgaatctaaattctgaaatcaaatattcatcaaatttcagcacttcaactggtcgataagtttttttcacaaacaatttcttcaattttttataataagttaccaaactctcaaatgatttctccaaagtattatcgattttgtttgaattgtaccactgtaaaatttcattactgaacaatttgagtaatttgattaatatgttcttgttggccaaatccaaagaaaaattggagtaaaaattatttatcaaaacaatcaacacttttaatatattgatctggatcttgagtaacaattcatagtcaacgtctcccaactcattcaaatctactgcagtatccaaattccagtttgggaaattcatagccaattgtgggtttccttggttaaaatttggttccattttcgtcttgtccgattcatgattcaattttttgagtaaataattctttttcataaccgatatcaccgcgtttcctgaatttataaacctgtgagctaatttatctaataattcctttgttgtcataaatgaattgtagtttaataaaaaaacaaatctatattcagttaaatcaaggtggacatcacggtggaaatatttggaatcaagcaacaacaagtcaatcaacctgtcaacggtagcatatttagggatgaatttgtaaatttttttcatacttccatccatgcttaatttccttttattagatttggaattattagcttttggtgacatcagaaagtttgtgaatttatcagaattcaaaatatcatcaacatcaatacccaatcctggaacatcatcatcgtcatcccctccggcaaaatcgtcatatccaccaccggctccaacagcaccaccaccagtaacagaactagtagagctattatctaattcagatataaaatcatcaattctaaacgtcaattcattgtcaataacaaaattgtgtttgttcacagatggatctaatggtggtgagtcctttttatcacctgatttcatcaactcatcatatttgcccaaatcaattttgaaaaatttgttattaaaactaggaattcgagaagcagggttagattcactcaatggagtctcattcagagaacctgatgaatcaattgaattgacagacaaattagatctattaatattgcttttcaataatgttgattcttgcagtgttgaaggggcaacggaaatggaagtggttgcatccaaatatgcttcaggaagttctggttccaagtttatggataatttcatgattttctccatatttatcgaatcacaatttaattcaatcaagcgcaaaagcttattctttatatcattgtttacttctcgacgttttattggtgatggtggattttcaagttgcctttcgtcactattattggcacccaaaaacaatacttggtttaagctctcattagaaaatataaatcccatagaatcatatcgacgtaaaacatcgtcattgtacttgataatttcatcataattggtcaagttggtcaaatagtcattccatctatcaaaggaataatttactcgtttccatatcgattcaagttcataaatatcaacactcttatcggtagtgttcccactgttgttgattactaaatctccaaagaaaggaatcactctttccttaggataaattttccctaaacctcttggtgccatgatatgataggagtctttagtgctcaaatctctggattcttcgttacctcctagatgggttgacttcccatgatcaatagtagactcattaaccaagtaccttctatccaactcaaacaagacaggtgaccaatcgcttttcaacaatctaatataatctggtgccactaacgaccagattttggttaatctcaaaaccggctgtgataatataacagatgatatacccaaccaggatgacatgttacctgatttatctaataagcatcctagatcaatccatttttccaataatctggctttgttttccaaattggctgaactcatgttcatactcgaattttccacaaacaaatgatttaccaacaatcttgacaaataatgaatgtgataatcattattgaatattaaagggttctttttatagaaaaaatctcgattagtgtcatcgctaattgaagaatatagcaataaggatttgtcaatattagagttccagttactaaaaaactttaaatcaatttcactaatggtataagcaaaatcaatcaaattaatttctttcataaacacagtggaattcaaatcttggaatggttgaacattaagtggtaaattatcattattgagtaaatctatcaacacttgttgcttttgaagcattttgtttttgaaaatagtgatatcttcaatgttgtaatgattgatcatttccaatactttcaaaatatagggggcaatgtcagattttaataaaaatccatcaaaatgttcttccaaattctgcaacacctgcaaaactctggagacaaccaattccaagtttgtcatgccctcaaatttcttctcaaatatagtgtgcacgtaaagagagaaaaatttcatgattttcccaaaatctggtaaaataggcaaaacatcaactatagtgttgatggtacgggtatccaaaggatcttgattgaacaataaaaagtggaaaatggcttctaatgaatttttcccatctttgaaaaatggagctgaaaatcgatgtgtatcaaaatcatataataagtctggatgtggcacctcaactttgtaatatgtaatgttgtgctctgatatatctatagaagaagtaatgggtaatgtaggtggagcagttactggtgtgttggggatactactagaataaggtgtatgaaatacatttctattgactggaattgttgtggtttcaatggtggaatttttccgcatccccaatggaggtggatgtgctgttggggtattttgaacaatggggctactgatttgtgaaacatctaatggtttggtatcaattagagttgaagcattagtttcaattgttgcattgtcattattatgttgaggaggatcagaaacgacattttcattaatgctattactgttagctaatgaagtggaactattattgaaattatggatactgctgctactgtcattattattcttcatcattgcttcaacttctttgggtataggaggttcttgtaatcgaaacttcttgacattcaaatttgttggtgccttgtaaagatataaatgtgatccttttaactcggcacggtacaatttcaaattattttcattgatttcagtcccattgaaaacaccattcacccacgaatgttttccaacagttgtatcatgatcatgtttaattaaggaattcaatttcacattaggtgcaactgacgattggaattggggagaattgagtttttttgttgtaccgccaccaccaccactaccactatttcctgtagctcctactcctctaatagatgtagatgtggatgtatatgtatgtggttgagtattattcagtgttgccaaagtagaagcagcagtagttgatgataaggtagatgtattagttgtggattgtttatctgataacgaatatggttgttcgtgtatggatgccatatcttcataatcaaaactggttgtatcctcgtgtgactcagtgtggacaaggtggtgatgttggtgttggtggttgcggtggtgattgtgattatgattctgattgtggtcagaatattgatccgatccttgttggtgtgattgtgtaggcaagtgttcattagaatcaaagtgatgatttgaatatatatttggtgaattagtatcgtgagaaacactctttcgtttatctttatcttttctattccaaatctttctcatgatggttgattaaaatattagtttgatatatttgttaggtattaataataaaaatcaaaaatcaaaaatataaaaaaatggatatgatgtttgtaagatcccaatagatttataaagaacaaagacggaaggaaagaaagaaagaaacaattaaataaatgaatcaataaagtgaactgaattgaagtgaagtgaactgaactgaactgaactaaaatgaaatgaaatgaatgaacaggttgtaagaaatttttaaaaaaacccaggaagaattttaagatttaaaattttagaaagaaaatttaattaagagtaagagagacgggtcgccaaaaaaaaaaaaaatcaaaaatcaaaaaaaaaaaaaagttgttgaaaattaaaaagtaacgagaatgaaatatacataaaaaacataaaaaataataccattaatatataataaatataccnnaccaccaccaagaaaaaatccaccacccanctcccttctacttagtcttcttctactacttcttgttgttgttgctgtcgttcatacctatttttttttaaaaataatttgttcccattttgtgtatgtcttaatatccatctattgtgcaatggtatagtctgttattgctttttcaagtgctgtacgtctaaactatttttaaaataacaatcaacaaaaaagataatacaaaattatgacaaaaatttacatacagaaacaaatggaagaaaaggaatgttcattgtcaatgttaaaacaataagaactaagaaataataataagaaatgcttgattcattgttatttttatccaccactagtaagaacaacaacgaatactcatgctcatattaggaccaatcctcttagctattctctatctcttttaaataatgtctctgtagagtatatacacatctggttatcaatttcgttattgtggaattataaccaattgggaataataatgaggaggggagggaaggacgaggacgagaaaactggaatggaaggcggacataactaaagagcaaaaacgaaacaaagacaataaaaacaaagtgtgacaaaaccaaaaaaaaaaaagataaagaagcagaacagaacagaaagaattaaaaaaagcgattaattatcgtctaaaatctttccaaatttaaaacaatcgttgaactcttcaacaacaacaacaacgccattatacaacttgataaatggtttcttgatttgaaaaaataaaatcgtctagcatgtaacagcatatatatttgataggaagttcttctctttttctcttttattttgtgtatatttttagtaagttgaatgaaatggaattgaaattgaaactggaatgttaaatcaatacatgtgtaatttaaaatcaaaaaatcaacattaaatcaaaatctaaccagtcaaacaatttcaatatgtaaattgacgtgtattttaaccctaataaattttttcaccccaatgatttctgcaatcgtgtaaatgtttcaaaaatgacagtttatttctcgcttgcctgtgctcgtaatagctaagtcttgtgtatgtatagactaataaattgagcaataatgtaagaagataattattttttttttgcaacagaatcaatcaatcaattagtgaatggtagctggtggaggggggagatatttgcgttatcgattaaacaaaattcttggtaattgattaattgattagtaacgtaatcttgtagattttcaatatctgatcattattatttggcaacacgccaattcgacttggagtttgtttagcaacaatatctaattcaaagcccatcaatcagtcaattcccgtttctttattatatcaagtaccctgtcagtcagtcagtcagtcagctgattgtcatatgtaagctagtgggtgaattcctattgttggaaactattaaacaatcaacctgttaatattacttttttgatttattctggtttagacgtgcagcacataaaataaaataaagtaaagtaaagtaaacgacaaaaaaaaaccaataacgcataatgacatttctcattaacgtgtaacattataatcacaataattttgtagtaggggtaagaaacaagaatttcgtttaactctaactttaactttcaccaaataaaaaagaaaccacaaacgacaatctatgaagaggaggaagagaaggaaataaacgtaatattcaaaagaggaacctgaaacacttaaaagggaaccgcaaaagttgctggcattgtttcattactttactgagtaataatattacaaaccattctaaaaatataccactagtaacttatgtagacaaatcaagattggttaaattatcaaacacaataatgaattcaaacaagctttttattttatgttttttttttaaaaaaaaaatgtcacatttttggtttcacccctgaacccctttgttttttggtgtaactgtttgtgttatctatgtattatgacaacattgataatgcaattaacaaatcgttttgaaatgattgataagtctaaccgatgtcaacaactctcaattataatcctgtttcctataataaatctaagcttcaaccattaaataactgcaaaacaacacagagagagagaacttttcaatggagactatttcaaatactaaattaaatatcaacgcacaatctaaaatgacaaaaaaataaaatagtactgtcaaaaaaggggaaagtgtaaatctttttttcatacccactgataataactactttgataacaatatcaaaagcctcaattaagccaattcttagcttaagccttgtcacaaactaatttaaaataaccagctacacctccttgagtataaaaaagagacaaaaataaaacatgtatataaaagctataataaatctaataaaaaaaaggaagacaaaattatcaaaaaaaaaaaaataagaagaaataaaaaaagtatactaataatagttgtaggagcaattaacttattaaacctttatttatcactttaaagtgacttgacatccatccattaatctcatggtagcaccaaccagtcttctacattctgtatggtttgaatccaattgagaaaaagtttgtaaaagtctaatagtaacataacttgcttcaactaaagcaagttgttgacctaaacataatcttggtccagttccaaatggtccaaaggcaactccaccatttctaggtaaattagcccatctttcaggaatatatttttctggttcaggtccgaaaaatctttcttgacgattacttgaaaataatgggaaaataacttgttcaccttttctaacaaaaattggataattatttccctttccaccaccttttggtagcacggtatctctattagcagttctagtattaatgggtactggaggattaattcttaaagattcatgaatacaccaacgtaaatattcacaattatgaatggtttcaaaagtgattgattcaacatcagggaaatgttcagtgatttcttttttcaatttattccatacgggtttattttgagccaattcgaaaaacataaatgataataaactagcagtagtatttctaccggctaataacacacttaataattcatctaaaatcactttacgatcttttgtttgtttagccaattgataaaggaaaacataatttttacttggatcatttaattcttcatcagtgaaattaattgctcgatcaacaaaatggaatacaaattcatgtaaatgtttgaccgcatttttaaattctggtggattcaccaaaaaggaaaaataaccaaatactaatcttttcgtcatatgatattgcataacatcaaaattaggtgcaaattttgatttttcttcttcactcatggtagaaattgatgtttcaccaagaatcagttttaaacaatcacaactttctccaaataaaaaatctgtagcataatcaatagtaaaacaatggaataaatgttgtaaatcaaattctccttctccttgttgttgaagtttaatcactttaattaacagttgaatatatgattccatagccgtgatttgtttaatatgttctttagcaaaaattggtctcaacataattcgactatgtttccaactttctccttcacttgaaaaaatcccattacctaataatggttttaaagcaattggtctagtaccaatggtccaattattcaaatcagcactactacacatggtccggaaattttctggttcaatagtaatgatttgatttttccctaaagcagtagttttcattgttgttgtatcaagattatcaagtttccgttgaatatcttgataaaaatatccacttttggttagattactattatcaacaagggctttaatcccaaatatatcataccatgtaactaatggtgcttgttttactggttgacaatcatatttacgttttattgattctcttttccaatattcagcaatataataaatgctggctgctataacagcaataggtaataaaattaacatttaataatttaggggagtgggggggtagaaattattcaatgtaaggatgttttatatgaaataaaaagaaatgagagatatgaatgaataaaattctttcttgatttaaaataatttgaagaaattcaatttgatttaaatagttgacagctagtagtagtgaatgatatgaatgaatatacttttaggaaaaaggatagaaggaggttggtggggagacgttgattcaaaattgtgtttaataaagtttgaatagtttattctcattaccataataataatgaaaacaatagtgataaaatatatatgaagacatggtttttttttatattctttctcctccactttcaattgagttataatagttgactgttgactagttgataattatattgataaattgaaaaaaaaaaaaaaaaatttcacgtggtgatgatttcatctaaatgtatgcggagattggagaaatgcgaggggaaaggaaagattactactagtagtagttgtttaactgactaactaacaactggagtgtggagtaaagaaacaactaagaaaaaaaaaaaacaaaacaaaacaagaagatcgttgagttgctcggagttattgcaaaaaaaaatttgcaactaatattatcttcggagttaatttcttctccttccaatattaatgccatgtcatattaattgtcatttgttataaataaaattaaaagatgtaaaacgtgtgtgtatggagcatttgaatgtgatatttctttcaacgtgtatcaagttaacagaagaataacaacaacaacagcaacaacaatgaacaacgttttattctgttttgactgtacaactgattgatattcaactttaaaaaaaaaacgaattgacatgaaaaaataacgcatacacatactattgttgatagtgttaaaggaggaagaactaactctttttttcagatattgttatatagtttttgatgaaaagtataattctgttttggttgttggccacagtaagtgctacgttgtttacgaaaataagatcaattcaatgattcacattaagatggtccaacataatagtaacggattttacgatgtttttgtttttcttaggttgtttcgattctcaacaaggacttttcaagtttgtgatttggtataattacttctcatcatttaaacaaatcatattaccatagatatattgcttccaaagtatacctttattcaagtaaagacaaattaggtgttgtttgttattacttagataattttgcatctgaaaattgtaatcaataacgatttcaacagggcttagtaaattataccatgcaagtatgttaggttgtttgttgttttaattaccttctaccaacgtatatagaactcttttcaaacatatcaaggcgggttttacttaaataatcattttgttaaaataagattaactgaaacaaaaaagtctaaaacaaggggagtctattgttgttttcccttattttctggaactctgtattatttattttaaacttcttgggtttttctttttttttttttttgcaacatttacactttccatgggtctaaaaaaaacgtttttttccatgtttttatttcaacatgacaatcacaaacaaaaacagtgttaccaaagagtcaatttggaatatgtgtgttgaaattgtttattcattgtattattatcatctgcatgtgctgttgatgttgatgttggtgattgtgagtgtggtttgatttgaagttccgttgtaccttgtttttggaaaaataagctcttctataaagtgacaatatttgtacctcttattttactaatgatattgtggccatttcctcgaaaccaagagtatgctaaaaaagttaaacctggttatgtgatgacttgatcgaagtatagaatttgcagctttaaaaaatagttttagaatgcaactcttggcaattgatcatttggtagtttctctgtccatgagcaacattttctatcaaataagtttcgttgaaaagtcaatatcagtattcttatacataaagtatcaaagccacaattatagttaaatccataagcgttgttgttgttgttccctttacatttgtgatcaaacaatgacgacaaattaaagttcatgtttttttttttttttcgtaatgtaaacaaattgttcaaattcaaaacaacaccacacacaaagtatctatatctatgattgaagatcattgttacaatatattcactcccctcgtacatgtacggcacaaattatatatgagcagttatcagttgtctgtgatgcatgtgcaatgtatcaacaaatagtgtggttgttgtttatgtgctattcccattcaatatggtgtcattgttttgcattttgtttggctatgtaggtttgtatttgttcatttgattagtacactctattgatctaaataagagaagcaaagttgtgtaggaattagtcggtgttacctaacacatcgtgcaaaaggaagaacagaaaaagttatatccgaacatgcattgtttgtctgcaaatcatgtaaatacattgggccatgatgaaaaatgaagaataacttctggttaatgcaaaaaaaaaaaataagtgtctatattattaaaaattaagtaattgttctatattataaatatatatatatgcttgtagttcgtttttaaattttttcatctttcttttcaaggagggtattaattacatttgtttctccaaaaaataataaacaaatgggtatttggcctctctattccaaaacaaaggcaaatttggatttatgacgaagtgatttaccataataatagaaaacaaatggcattggcaaaagtaaaataccaatacaccctaaaagtgtacttgcccatttaattgttaaattggtaaacatttgtctggcaaaaagtgggaaaacagccccaaatgcagatctaataaatgtgttaccagccaaggcagtggctgcatataacaagtagcaatcaataatataattgaaacatggtaagaaaatcaacattaacccattaccaacaaatgcagcaccaatgacggggactatccaatggacatgttgtgggtaattaccagtccaaccaagccagaaaataccaataacaaatgtgaatccaccaaccatcatgggttctaatcttttttcggggatgattttaccaccattatcttccatggctttaatgtatcttttttcaaacaacataatcataccaccaccaatcaaaatcccaatcaacatggccaaatatggtaattcagctacaccttgaacaaaatgatattcacccaagaaaatcaatggaatagcagttaaaaacaaataaagcataccataaataaaagcattataaagactgaccaaaaacaaaattggttcggtgaaaagcattttaagtggacgagcaatattattttcaacaatttctttcatacttaatttcaattcttcatgtggagcataaatcccccaattacctgttcttcttcttaattcttcagctctacgtgttaaaatcaatggatgatgagtttcttgtaataagaatgtattcataaataatgccaaggaaccaataatcccacagaaatatgaagtccatctccaacccaaagcactatttttcacagtgaatgctcccaaaattggtgcaagcataggtccaccaaacaataacatggagaaaatggcaattgccgtacctctataacgattattaaacatatcggccataacggcaggagccacaaccaatggagcagcaccaataaacccagcaaagaaacgacaaatcataattgtttgaatatctttagcagttgccacggcaaatgaaaaacacacataacctaaacatgaaggaaccataactaattttctaccaaataattctgataatggaccataaataactggacccgaagcaaacccaaaaacaaacaatgacgtggttaaagttgctggagtccaaccaatatgataaatttgcattatatcagcacttgcttgagaaaacattgctgatcccatggataccgataaggcagcaagaccaacagatgcacaatataaaatttttttccaagttggataattatgaggatgatcaggatcatcgggaccatcaaaggcaacaacataaggatctcgtgaaccaagcattggaggatattctttacctccacccattggtggcaatggtttactcgattgagatgcagtacgtaataaactttcagtattcataatacttctggtggctcttctcgataattcagtatttgattctattctactcaattcatcatcaggaggtaattcaccaccaacattagcttcataatctttgacattttgtgcattaaaactattaatttcattttcttcatcagcagtgttactactggattcaactgaatcagtaggtccaacatagctttgtacattgacattattgttattagttatatgttgtaattcgtcattagaaacggaagttgtagtattttgagtgattgttgcttcaggagcaatatcgttgtgattgctgttggtattgttattcattgttctatcaatttaataaaaaagaactaatggataatgaattttccaattgaatttagaaagaagaataaaaaaccccgaagaatttttttttttaaattaattacgactattcgtttatatatatatatatatactgtgggtaaaggaaaaaaacggaaaaataaaaaaattcattttcttactgggggtttataattcctaaatagaagtagtagtagctgttttattttccgtgcgatgggccggccgaaacaagaaattcctttttttgcttctgcttttgcttttgcttttgttttgttttcatcctcgcttgattaagttaatgttaatgttaggaattaaaattttttcttttccgccctcccgtttgtgtgattttctattagttgttgtcgtttaaatccgatgtgctaaaaaattttatactaaaacaattactagtaagatgttatttctttttattttatttcattctacttagttgttcactttctgttatataaattgttaggttgagagtcgggttagtagcaaaaagggctgagcttcatccttcatacaatacacaaaattacaaaccacaccggagatattattgaacatatttttcatattaaatccgaatagatgaattagtaatcagcatcattatcaccttttgttaccacaccagtttgattttgacagtatatccaaatacttctatttcaactgtttcggataaactctaaaagcataaaacatacatcaaggtttttggaaaactatttgcaccaaaagtttaatcaacaattgtaattctcaattaactattagtaatatcatctaataatatcatctaaagaagaaagctataactaacctaattttcattggtccttctccttcttttatcttatcagacgtcaaggtttagtgaaaaattatgattaaataagttacaaattattcgtcaaccaaccaacacgcatgcacacatctaaactaaacatcggctattaatttgcttttttcagtaatatcggcaattaaatatttggcatatacacgactagcattgtcatgtacaaaaattagtttctgtttaatttagcttgatatattcaagtcaagatttaatgtgtgatatatgatttccccaaagggctatgtcatttgatgaaattttattggggtcggtgtttatatccttgcggagtttagtatacgaaatagaatgaggggattttatttattttctcttctattgttgttctcaatgcattaacttattaaccctgtagccgtgttgtttaagccgattgtttctattttcgtattatttgcgctcatcacaaagtatataactccagacattgtttgtaatacctccgtagtaataatagtaaagaaccaaccaaccagccaaccaactagaaagtgacagaaaacttcactccaacaaaaaggatggagtaacaatgagattccctccccccccaaaaaaaaaaggttaaaagcctacctggctactaactttaataatacaaagattgcttgtcactttatcctggaaagactttctatatttggctgtggagaaagaaaaaaagtaaaaataaagaaatgtctagcatttaaataacgtacatacatatttatatatatatatatctaaaaaatctagaaaatcaatcaatcaattaattgtcttaaatgaaatataaacttttttgaaataaaacgaacaaaaaaaataataaataaatataattgtagtcgtaatagtagtagtagtagtagtaatgtcatatatgtacagtataatgtgaatatccccatttaaacaactctttgtttacttggttcaaacggaagggccaaggcaacaatcccaatgacaccaactaaagcaccacaaatccaaattggtactgccgatgaagtatcagaataccaagcaataatggggaccattgcggtagagattcttgtgaaaaacaaacataaacaattcccagtggctctagcagctgatggcataacttctggggtataagcatacataaccccataatatatatacaaggcacaataaactgctgatgttaatccaacattttgagctctggttctcacggcagtataaccaaataataatgccatggtagtgactccaccaataaacaataccccctttctacctaaaactggtaataaatataataataacccagcaataatgggaccaccaactgaactcacattagaaatgactaaatctcgatatactccactagtggtatcagcagagatattggcaccacgagtagctaaatattctggtaaaaacgctgaatataatggataagcaatacctaaacaagcccatgagaaaaacaacaaggaagttgaccaagctgattttttggttgcaaacaaaattttcaaatgttgaaacattaatgacaatgtcccaccaaaactgaaatgtttcctatagtcatcattactttcaatttcaccacattctaacaattgttccaacgttagtgaacatttacgattgtatttgtgggcaatttcttgtaatacttcaactgcttcagcatcacgattattagccaccaagaatttaggagtttctttcaatctcaccactgtgagtcttagtatggccatggccaaaacaattgatccattagtataaaacacatatctccaaccacgattgatatgagatggacaataatcagctgattcacaactattatttggtaaaaatgcataagctaatgcaacagcaatagtttgaccaatcccccaaaagaatgcgaaaaaagttaataaccattgatctttatgaggtaaatattccaaaaagacacaagtatccaaaactaaattcccaccagcagcaaatgaacttaataatacaaataaacaataagatgccatattgcccatcatccccgtcatgattgtgaaaatagcacttaataataatgataaattgaaagctaatcgtctaccaattaaatcagctccaaacccccatactaatgctcctaaaatcatcccaccggcataacattcattactaacggggaatttataaccaaattgataattaataaatgtacggacactactttcaagataagtcaacatacaatcagtacaataacccataccattcaagaaaaataatttcaaatgataaggagtaaacccaatttcatcaatggcatcattaattaatttcattttattatgtaatatggtatcattagcttctaaaccaaccatatcaaattccagcgatgtggaatcttctaaatagttttccttatgagaaatgaaatccttcttatcatcatttccatcattgttgatagaatggttagagtggttttggttttggttttggttttggtcctcgcccaagttttggtctggggtagtattcttttcaaataatgacatgattaagcaactaagtaattaagtgaatgaatagctgaatatgtcaaaattaaaagaaaaaatgaaaaagaaaggtataagtaatataaataggaacttttgatagttgaaaaaaggaaaaaaggaaaaaaaatcagggggaaaaagggaaaaaaccgaagagttaaataattaattctttgttacttgattttggttttgtgggagtgaaaaagaagaagaaaaaaaaaaaaatttttcttgttagtattttaattaactattgacaagaaaactaaaatatgaaatatactaataaagtacgaaccaaccaattatttgaaaagcaattatatattggttaaaattaaacttttgaattgattagcaatcaattaaaaatgaaaaccaccaataaactttcaggatcagaacgaaagaaagaaagatcacgaaaaaatttttcagtattaaaaataatattaattcattgattcatacattcattcatttgtacatgcatgaatgcaccatccacccactcactcactcactcaccgcacaaaagtctaaattggcagagagttgtgactaagtactacattctccacaaaatgtataaccttaaccataaccaacaacaaggaattaaatatgtagttatatttcctagtattataaaacctctatagtagttttttgaaagacacagatggttggttagttacaattatcaacagtcttaatcaagtgtaaaatagtacttgcgagagaggggggggggggggaagaagttagacaagaagtacagcctttggaattattattatcatttttttaataaccttctctcccctatacggtttaacccacaaaatcatatcattattacatcgtactagtatactttatttatgggatgacaatttgatttttttttgatcatgaaacaacgacaacaatcaatcaatcagtagttccaagaaattcacaaaatcaagaatcgtgcaacatggtatagtaacaaaaattgacaatagcaacaattgcaaagcaaagcaaaaaaaaaaaagaactgtctttcgtatttaaaaggctattgttattcaaaggtaatctttttggatattatatcttgttaaaaaggaaattaaccccaagttttcaccaccaccacaaagatttagttcatgggtccaaatttattattatctagaagaagagtgattttgtggggggggggggagaaaattatggtagaagacttctaacttagggggtcttttgattctagaagaaataccccaagaagaaaaataatatgcataaattgcacgcatgaccatttgtggtagtagccagttcttagggaggaggggagcggtgtgacaagaaatgaatttttgggcgactgtacgccgggaagtgccgagactttcctttctttacttcactttacctcccattcgcatatgcaataagataaaatataacactttaagaaatcgatttgacaatctgtctagatcagaccaagagaattaacaaaatgtccttgttactgttctaacactactctgttagccacatgagtaagatacacctttactttatgtgtatttggctaattagtgtagaccctgaaccatttttttttttcggtgattttttgtagatatttctcctataaaaaaaaaatgtcttggtatttcattgctgataaatattattgccatagaatagaaacttatctagccaataagattaagctactatagcgttgagggttggcttaaccccctcacagaaactatagaagttttaaaattaaacttttattttaaatctgtggctagtgttgtggtaaagtaccttgactattgaaatgagtctacattttgaaacactgtgctgtgatgtgatggatttttgtatatttatgaatacaaccaggtataaatatatatatatataaaacacaaacaaacactattcataatcatcgatatatttttgtctcatttccattactttagtaaataatgaattttttgaatcaccactatctaaacgaataattatatcatcaacatcccaatttttcgataaataaatttcaatttgttcattaatttgaattaatttattatataaattcaaattttgattaattaaatcaggagttaatttaggaattttcgaattttgtaataaaaattcaccaccggtattattaaaaatattaataattaaagaaatataatttaataattgatttattgctggaccaaatttcatatttaattctgataaattaattggatcaacacataaatctttagttttagaacgtaaatgatattttataggattagtttcaatttcatgacataaattatataaccaatccaattcaatatttgttgttgtaggaatcaattttgaaaattcccaatcggccaaaatatcaatacttttacggattaatgaatatttcgaagtaccactaggatatcgatcatatacatttaatttcaattcttccattggatcagggaaattatcaaaacattttttcaattcatcatcaattttaatattaggtacatccaatttatataaaatcccctttatattcccccaatgtacacaacttttcaaagctactaatacatcatgggataataatgcctcttctccataataagattcaatgaaatatttcatataataaccttctaattttgttccaatatgatgatcagtatgtaaaaaattcaattttgaagcaatcattaaattaaccccccattcaatatgatgattttcaataggatgacattgaatataatcatcagctaaatcttttaaatctcttggatcatatttagcatttttaaaatgaataattgaagaattttcaacttcataccatttatttttctctaattctaatgctaaacttaatattgtacaacaaaatgatgggaattgttgtaaaatttctccttcaccaatattatataatatagtaaatgctgaataaaatgataatttttcatttaaatcttcaggataaataattaaatgtttatcttcttgacgaatcctttggaatgtattattaacaaatcgatatttcctaccctttttattatattcaactttttgtaaattatcaatttgatgtaaaatatgatctgaaaatgtaattaatgcatctgatgtcgacattaacgtggtagggtgagttgttgtaggggtagccataactgtgggggtagcagttgcagtagtcatatctcactaacaagctaagctagttgaaagagtttaaccagatcaagggtagtagtagtagtttattaataaattgatgtgtgtcaattttttttttttttgggtttgtttttgtttttgattttgattccagggtcaggcagtcagttagttaattgtcgtgttagagaatagaatttagacgagcaaaaaataaagaagaacttgacaccatcccgtccgcgtctaaaacaaaaaaaaaaaaagaatactcggaaagaataatacttcttcagtctatatctataccaagtaccaaacaacatctcttcctacgtattatgatatacacataagtatagtatatattgaacaatattgatacataaaaacataataaacacacaaaacttttaaactttttctaatagtacataactgggacaaaaaaaaaacaagtctaataactccacaactcccatcattcttctaacttgtattggggaaaacaataatctagctaataattccttttaatggtcattcgcataaccgccctatcattataacatttcttcatcgatattaaaactagaatcaatttcatcttctaattttacagtatcatcagtcattccaaaatagttttcgtgttctggcacaaaacaatcgcgttgttggtgaaattgttgatgctgctgctgctgttgttgtggttgttgttgttgttgttgttgttgtctataaccatccacaacgtacccttcaacttcactttctggactaattatcaatccactcaaatttctattcccattatgaggtgtatgtattatattatcttgtccagcattatgatatattgattgtggagtatttggagtttgatataatttttcaattgattccagtttaaatgaataatcttctaaactacaatcttcaaattttgttattgtttcattagttttagggtcaacaaattgtcttaatgtaccccaaggagtgatttttattataccaccatcgggatgaatgaattgtggccattcagtttccgaagtaatttgatcaggtttagttaaatttttcactatacgttcatcatcaatataatgttcataattgttggcattggcattggtattggtatcatcatgaaaggttaaactgtttttccgtttattattatgagggaaacaattagtagtattagtactagaaggagcaggtgatggtaatctataagcaaccataggtaacagttaatttaattgttgttatggggtaggaagtgggtattaaagtattgaataaactaaaagaaaagaaaaagaaaagtaagaaagaaagaaagatgtgaaaaaaaaaaaaaagagagagagagagagcgaagattaaaattttgttcactttgtgtgggaggaaagaaaaaggagtgttgcaagattaaaaattcttctttagttaagtagtagtagtattatcaccgctgctaccaaacgtatacattgtgtgtagtaatatgtgtgctgcgaattttagagtctcagaacttgaaaaaaaaaaagaaacaagaaatttcaaattccatctgctgatagaagacgaatttaccacaaatattattaaacgcgtactgactagtagtatttacttaatattcattcaacttattgtatatgcaatgctggtagtgtttattatttgtttaattttaattttgacgcgtgattattgaacggtactcgtattaatcaactttagccagccgcccccccaattatctcaagaaacttccccatcttaccacctaactaactaacgcgacctgtaattcgtgcacgacttttattttcttttttctttggtttcaaacaacaggcatgtacacatgtacacgactaaattttaacactcacacgaccatgagcaaatttcaagtttcccttcaattttacaaccaatggcattaacgacaacttgcaaattcatattaatctatactggttttacctatgttatctatttaaccagacattaatcactatcttcatcaacaccaaaatcagttaacccttctcccatatcattaatgaaatctgaacgttgaacattcaatctaggatctaatcttcttctcaattcttgataatttctaatactacgtagttcttcctcgtcttcctcttccctatcacgctgatatccttgttgttgtagcacattaatttcaatttctttttgtctaataccatcaggaggccaaggtaaattcaattgatcatcttgtttataatcttgggaaatttgtggttgatatccattactcttaggtttaccgaatggtattaaccacatataaggataacccaaagcatttactaaattcttccatattcctaaattataaggaaatatcaaatcatcaatagtgaaattttgtggcactattgttgaatcttcattattattggttgctaaattaattaattcaacatcctcatccccatcatcatcattatcgttataattgacattattggtggtattagtccaggtgttcaattcaggaaatggtttacctttatgtaatcttccataattgaatcgaatcaatctccataatcgtttacttgaccattgaagttctaatctttcccattcccatatttctatttgtgtcatccccttacatatattaatcaaacatcgaatgaacaacaccaatatactagcaaagacaaaaaaatttaatggagtaatagcaattatggccactaattctgtcttgttgaataaatagtgtggcatattcagattttcataataattaataattagtttaatcaattgaatcattaaatatcctgtaccccaaatgatccatccaagaaatctcatgaaatgaggtaaattattatttccaacacaattcaatgtccaagggcaatgatgatccatttgtaaaacacattgttgacaaattttacaatgatgacttcttggtggtttataattattacatttcttacaataccttatccattcacatctatctccactgattggttcctcccttattagggtttcatcttctctagattctagacctaacccatcagaatcatcctcggtttgttcaattcttgtagacgacgccaaagatggtttataattttttgggactcgtccgggattggtatatattgccaataaataagatatccatatcatagtcacataaaattcataaatcaattgttgtttcattgttaaatggtgtcgaagaataaaataatgtgatccataagataatgaaaaaatgattatacaaggaataatcactcccaatatgggccattttaactgtactgccatgattattcagtaaaagtattgtttaccatctaattatgaaaactattcaacctagcagttgttgtatagattgaactgtggttgtactaatagttatttagttaatctttaggagaaagtgagagagaaatcagagagaaattgaatcaacgaactgaaccataaaaaaaaaaaaaaacctttgaaaaataatctcagtggcaatatcaacaaacttactctcttcttcttttgtaatcattacaacaattcttatataactaatattttatctatatcatggtatgtcaatttgttacaactaaacacaatgcattgctcatgtatactaactgatttatagacttcaattggtacaggttacgatttatccaacagtgttttctcaccaggtatgtaatcaaatcaaattaaatattattattttttgccctatcctgttattgcagtatactaactatatatagatgggagaaattttcaagttgaatatgccatgaaagccgttgaaaatggtggtacatcaattggtattaaatgtaaagatgggatagtattggctgtggaaaaaatcattcaatcaaaattattaatccccaagaaaaacaaacgaattcaaactgttgatagaaacattggagtagtttattcgggtttgttacccgatggacgtcattttgttaatagatgtcgtgatgaatgtcaatcattcaaatcaattttcaaaactatgatgccaatatctaatttaatggatagaatgggtatttatgttcaaaattatacttgttataattcagttcgtccatttggtatagtatctattattggtggagtagataatgaagatggggaaccatacttgtatatgattgaacctagtggtagttattgggggtataatggtgctgccactggtaaaggtcgacaaattgccaaatcagaattagaaaaattgaattatgaagaattgacctgtttagaagcaataaatcatgctgcaagaattattcatttgagtcatgaagataataaagataaagactatgaattggaaatttcttggtgtagtaaagaacacactggaggtaaacatcaatttatttctgatgatttattagaacaagctagaaaacttgctgaagaagaggaagaagaagaagatgatgatgaagaagaagaagctggtgctgatgatgaagaaatggctccataatgtgaatatataggttcaaattttgttttgaatgaaaacaaaaaagaaaagagagaatgaattattattaacttactagatacaattaaatagaaatacaaactatcaatttgttgtttcaaagttgttccatgttaattgtatgagtgtaagaaagggggggggagtgtgtatgtcgtggtccccttgagcaaaaaaaaaaaaaaatattttctgaacgtgtaaaaaagtaaacaaatcaatttgatagtaaaagaaagaagttaacaaccaagtcataccttaccaaatcaaacgtctatatgtggaatagacaactaattttttattttgaaacatttttaaaacattattagtaccttgaaagctttttattttccatgtcaaatttatcaattaatgaatcaaatgataattcaaatgtatccattttactgaataaaagtggtgctcaaagtagtactaatagtagtcctaatcttattgtttttaaacaacctgaagatttatcaattcaattacaacaacaacaacaaggaactcaagaagatacaccagaagaagaagaagaagaagaagaagagatggaacaaataacgcaattggaagttcaacaagaaaaccaaccagacactttatcttctagtccatttatttcacgtccgaattcaccccttgatgatataattagaccccaaggcacatcttcaccatcattgactattagagattcttattcttctcaagtagatatcaatatatctaatttacacaagagtttgaatgagatgagattatcaactgatccagttgacaacaacaacaataacaacaaagtcaacaaaaacaaccctaccaatagtgatatatctaatgatgatatcataaccatcgataatttgactccaagtagaatacaaccaaaaaacatatcgccatggagacaattccgccctacgttacgtggtagtccagaatcaacgccacggctgttgtttcaaaataaacccaatttgaaatttaataatggtcttagtcctactaatggtagtagagatatggttacaaataatattgctacaacaaccaaatcaagagaagaagaattgaataaacgaatagttaattataaaatccaattaaaattgatgaagaattttttacaagaattgattgatagaaataatcttgatcctcatgaatttcacacattattaagaagaaacaataacaacatcatgaataacgaaaacaacccattatcaacctcattgtcgcaaacttcaactttagaaattcaacatcaaaatttacaaattgaactagatgaagcacttgaattaaataaacaattgtacaacaaaatagaaactgcaaataaggaaatcagtgataaggatttgcaaatttctaattatgaatcaagaatcaatttaattaattattctgttgatgaattaatttatattttgatcaatgaatatgataaaaataattattcccacggcggcagcaacaccactagcccgggtaaagaaactttacaacaatccatatcggcacaattagaagttaaattgaatgttttgaaattagaattgatgactagattggatcaactgcatcaatataataataaaccacatgatttatttactccaccatacacatcatctgaatatggtgttagcaccaacaatgtcgctaataagaatgatttggaaggatatattcatattatcgaagatttgattaaaacggttgatgaattggaattaacttgtgaaaattacaaggcaaataagaatgaattacaaaatcaattagttgaacaaataaatgaatcgattcgaattaaaaataatttccaaattatgtccaataaatttaatcaattacgtcaatcattgagtgagaaagaaaatgacaagaatctagatgaatttagtaaaaacaatcaccagcaacaacaacaacaacaaatacaacaacttgagcaaaaattgattgagtatgaaaaatgtattacaatattacaagatgaattagatcaatacaagcaaccttccgataccaccaatactacgaacaacaacaacaataacaataacaataataacagatcgtcatattcatcgtacaataatcatcgcaatagttcattgaatgaattgaatttagtgaatgattatttacaattacaaacatcgtatagtagaatcaatgatgaattgaatcaggtaaacaatgattataagcttttgaatagttcaacactggagaaaatcaacaatttaacatcaaaattacaagaaaaatcaattgaattaagaaatcaaatggggttgaataataaattacaaacagaattgaatttatcattagataaacaacggaaatataatactgaaaggatacaaatgtcgtacactgttgattcattgcggaaagacaatgaggcattacaattgaaagttaataaattgactgatctaatgacaattgatagaactagagcagagagtaattcccaatctacagccacatcaacatcaacaccaactccacaaacggctccaactccagccccatcagcactagcaaccgtagcacgaactgcctcaacgacatcatcttcaacaacaacggtaaatactaataccaagacaacaaacgaaaacaacaatagcagtgctaatattgaattgggagtgaagaaaatctctattttagaatatcaatacaaagatttattattatatgatactaatcaattcaaaagattaattgaaagttataataaaatagctgatgataaatctttatatgatccgaaaatgaaatatgaaaaattattaaatcatataactgatattaataatagtaatgggatggggaaaaatattgatattattgaaaatattacttatattagagataaacataaatcaatatttgaatattttataagagccaccgatatattaatcaatgatcatatcaaattgttattaaaagaaaatgatgattcaattaaagttaaatatactaaattaaatgataaattgaataaattgattaaagaaaatgaatcattgaaatcggaattagaatttatgaatcaacaacaacaacaacaaaatcaaaatcaaaatactaatgttgatggagatgattacggtaatactagtactaataacgatccattatctaaattaagaatgaatgatttaagaaataaatggaaagcagaaagagaacgaagaattttagaagatcaagaagccaaaaaaagatttaaagaactagaattggaaattcaacgattgaatgaagttattggtaataataataataataataataataataataaacaaactacaaatgataacaactaaaggaatcaaggtcctattttcaccccgacaaagatattttaaagtgaaaacctacctatattaacttgtatttgaaagattcttgatattcaatgatattgcctctctatgtatttgtattttttctactattatgagttgaaattgatagtatttatatatgcttctatatttattaaatgaaaattgtcctaaaagattaaagagccttgttggtggtgttggtggtggtggtggtggtggtagagatgaagtaaagaatcaaaagtcgtgtctgattgatttgaccacaagacacgcacacgcacacacacataaaaaaaaaaattttgtacgtagagtgaaaaattttcctgtctcttttttttttattgtttttggctttttcaagttcatcaacatagatcatacttttaagtaacaacaacaacaacaataacaacaaatcattttgaagatgtcaattaacgaggaagattatcttcaacttgaaaaggaaatcaaattagatgacattgatttttctgatttagaagaaaaatatgaagttaatattggattagataattatattattgttgatggagctccaattgcaccagaagctaaagttccagttttaattaaagttttacggaaattattttctcaagttggggaaattgttgaaggagatgaaggaatttatatgccattagaaaatggtaaatctaaaggatatcttttcattcaatttaaatcaacagaactggccgatttagccattaaaaaattacatgggaaaaaattggatcaaaatcatcgattattagttaataaattatctgatatggaaaaatatggtgttgatggagctgttaatgaagaattcattgaaccagaaattgaaccatttcaaagtcatggatatttgaaatcttggttacaagatgaacaaggtagagatcaaatggttttacattttagtgaaacggtaggagtttattggaataaaaaatctgctgatccagaaccagtcattgaaccaagaaaagggtttacttctaaatatgctaaattttcaccaaaagggacatatttattttcaattcatcctcaaggtattcaatcatggggtggagctaatttcaatagtattaaaagatttttccatcaacaagttagattagttgatttttctccaaatgaaaagtttatggttactttatcacctattccaattagtttacccgattcaacggttgatcgtgctcaattcccatttggtcctgaaagtgaaggtcataaattggtcatttggaatatgattactggtgaaccagtcagaacatttgctttaccacctcatttagaaggacaaaaggaaatgccgtggccattagttaaatggtcttatgatgataaatattgtgctcgtcaaggaccagatgctttagccatttatgaaactgaatccaatttccaattattagataaaaaattggttaaagttgatggtattcaagatttcgaatgggctccagctggggttaaacttcataatagtaaagctgttgatggtaaacatgttttgagttattggactccagaaagtactaatcaaaccgctagagttgccttgatgcaaattccttcgagagaaattttacgtactgtcaatttattccaagttagtgattgtaaaatgcattggcaatctaatgggaaattattatgtgttaaagttgatcgtcatacaaaatcaggtaaaactattttctccaatttggaatttttcaaaactaatgaaagagatatcccagttgaaaaattagaattaaaagatgtggtggttaattttgcttgggaaccaaatactgaaagatttattactattagtagattagatgatggtaatccgaatcctgctattccaaaaaataccatttcattctatgcaccagaagttaccaaaggtggagttaatcacaatctgaaaaagaaaggtggtgccgccattgctgctgctgttgctgctgctgctattaataatcaactgtcaactaaatataaggcatacaccaaaatcgaaaacaaacactcaaacactattttctggtcaccaaagggaagatatgttgttgttgctactatttcaagaacttctggtgaattggaatttttcgatgtttcatttgatgatgaaactaataaaaaatcattacctgctaatgtcaaattattaaagaccgataaattttctggaatgaccaatatttcttgggatccatcaggtagatttgttgctgcttggtcaacttcttggttacatgccattgaaaatggttatagactttatgaattcactggtaatttattaagagatgattcaattgatcaattcaaagattttgtttggagaccaagaccaccatctttattgaccaatagtgataaaaagaaggtcagatccaatttacgtgaatatagtgcacaatttgaagaagctgatgctatggaagctgatgctgctgttaaagaaatcattttggctcgtagaaaggctttggaagaatggagaaagtaccgtgccaaacatattagtaaacaaggtaattccaagaacgaagttcaagcagaaattattgaagaaattaaagaagagattattgaagaaaaagaagaaattgttgaataaacgaattaccgacaaaagaaagttttttaatccatagttataatagtacttatatatatatatgtatatatattattattattatttacatgtatcatttataaattctatacttttttggtacgtaattgtaatccatgccattttttaatttcatcttttaaaatttcattaactaatcgatgttgtttaatcatagttaatcctttgaatttttcactttcaataaatattgaaaacatcgatccacaacctcctgatacatctttaatttttaaattcactggattcaattcttgttgtaaaatattataaattttcagttcatattcatccattggttctgattcttcttgaggagtcgaatagttacgtttcgatgacaaaaacggcgatatggttctttgattaatactgctgttatacttgtagatattactcaaacgaatatttcttattatattatttctaatcatgatggcaataaaaaactgaataggtaaattgagaataaatggaaagagttattggttatctcttcatcgattcatgcaaaaagttttattgattctgaattcaattgaagaattttttttttttttttgtttgtttgtttgtttgtttgttccaagctgacaaataaaatgtcgtgtattaaaaatcttcttaaataaaacagttgcgaatggaaatgacttgattcaatgcaacatataattaatagtgttgatatataacttaatggacaatggcatggaacagaacatatctacttaactgtcagtggggtgtaattgatttggaaactacctcatgaaagagttagaagtaattttgataactcataggacaagaacaacagtggtgtccaataagacacgatatttatttatccaacctaatgaataattaacttatggactggtgctccttttattgaaaagtccattttgggacagtgataagccaatgtcataaaacagtgagggaattttacattgtatggtttaaagccagacatatattatcatcatcggtaaataaatcaccgagaccaacaaaaaaaaaactccccagaaaacaaatataatagttaacgtccttattgtttgaattcaaaagtatatgtttattaacaatcatgcctcctatttccgacattaatgttatagtaaattatctttcctagccaaaattctttaaccccacaaacacaaataattatgaacccgatgatcgagaagaaaagtgattgttttatttcccgcatcaattaaaagtcatgtaaaattcaaagataatttattgatcaattacttgaaagatcgatctcgagacagggagaaccattcattgatgaccagttatattggtattactgatgccaacaaagccattctgaactgaagccccgaaacaagggtcacacgaaatatgtatatttctttgaaagaagggacgagatatttatgcttaagaatgagatagaggaaaacaaataagcgattaaatgtaaaactgatgaaccataaccccaagtagcataaggatatgtatagaaaaaagcctacaattactgatcaggtgtagattaagccactatgtattaagagcaaactgattaaatatgatcaatctaaacagtagctcatccatccttaaagactactctcggttgaaaataccgattgatcacaatgcatcgtttccgaaaaccggtttctttttttttaaaaaaaaaaaaaagatttaaagcaaacacataatatatggcggattagaaaatttatctccgaagaaaactctttgcacggggatactaaaaaaaaaaacggctcggagatattatcaagacggttaaattcattgccacaaaaaaaaaaagcgcatacttattatttgtcaatcattcccaataaggaaagaccgaaaaattcaattctaccatttaatacttttcaaaatgatgaaagaaatagtccatacaatcaaatcacataggtcaaattatcctaaagtctttttatttaagataagcagttgatttaaaaggtttcctcaagtatgtagtccgcactattctttttttctttctttttttggtttcatcgtccgtcgtcgtcgtcgtcatcgccacaaaaaaaaaaggcactaaactcaatgcaaattaagtctaactctacattaggaatctttttttttaacgtttgactcaattagtattcttttacaaatatagggaaatacgaaaggtgtaactgagcaaaaaacagatatatgtaggggaatgggggggtgggggaaaggacggatgttgtttcaatagttagtccaacaccaatcaaataatttgatatgtcaaacccagagatacatgtattctaataaagttaattcaacaaatatgaaaaaaaagaagtactactgtaaaaattatatacggatgtatgtggattagtttacgtcagatccaaaagatcatttatttagtaaggttataaaaagtagaaaaagtaattttataattgctgttgaagatcaaatttgctttttttgtttgatttgcgcgtttctaaaatcaagtggctcaacaacatcaacaacatcaacaacagcaacaaacaacaaacaacagccacaacacaaagaagaatattgagcaacagagcagaacaaagttgaacaggtcaaaactcaactaaaccaaactgaatcaaaaattgatatcatttgaaaggaggagggaggagcgagatgtgtagtaatggaaagggtggaacagctatataaactaaatccacatctatatacatatatacatacatgtatagctcctaaagttctagaagagaatctaaattccaaattttaatgaactattttatcaaattaatcacaaaacaccgatagcaatggaattccatttgctattacataactcctcaagcataagcataagcatgtatgtatacatacttccctggaatatagattatgtaataaattataaaatctctttggtgtgaaaaaagaaagagaaggaattacctagaacaatttatcctaagataagagtttataatgtgttgatgattgattaatagttcaacaaaaaaaggaatctacaagacatcaattgtagagatttatttatatgagtcatactaaacagtactaattaataatagtgaaagaaaaatgatggattaaaaattttttggatagatctacacacggctaattatagagatggtgatggtgtacgcatataacggatatttactcgattgggatattatgtttttgtgtccgtgtgtatgtgtgtattagtcatcggatatttggactccaattaaaaaaaaaaaaaaaaatcctaagcaaattacacaaacataacaatcgaccctctcttatttaattataaaaactgaaaaggagaaaatgatgtaattgatagataaaatctataataaatacaaacagctttgaaagtggtggtggtggtggtggtggtggtagtgatatctatagaactaacttgatattatcataaaccttacagttttagtactaccacgtggatttttaaaatctcaatagtttctatagtggtggtataccactactacgactgtggattcactcagagtaattctactaattgatgatagttgttgataatgtttagtggtactagaatcatatgtgatctatttaaaggaggggaaggcgagtgagtgagtgagtgagtgagcgagtgagtaaagtctatttttgataaaaaaataacatccaataataacttaaattttgataaaacatatcttagttagtatcaatttagattattagtcagtatagcctccttctcttcccacctttctttgtactaacttttacacttttataagttatacgtaactttaaaaactcaattcaataaataacatttatcgaatgttcaaaaaaaataaataaataaataaataaataaatactgcaaaccttattcttttgtttcaatggaacaaacaaatttttgaggaaaattaaattataatttatgggatgattttaatggaatgatttatattgaaattttaaattgtaatattttcaacatggcgatccgttaaagaacttttgacagggttatctaccaaaaacagtaaaaaaaaaaaaaattaaccgaccagaccatacagtaagaactacaaacatgtaatataactctactagtagtattttaattattgctatgaagtaataataataataatatttcattgattataatatgtctagacaagatgaatcaaacagacaactcaagattcaaaactaagggtttttgattgcaaaagaagaagaagaagaaaaaaaaaaacaaaaaagtatacaaacccaacagcaatcaaaatataacaaaaaaaaaaaagaatagcgtatatccttattattattcattgtaacgactgtggtagtggtggtgagttcaaacttcactttagttgcgtttgacgtcacaatctaaaaaaaaaataaaaattaaaatctatgttagatgagaaattactgcttgatcaaacatcaaaaagttagacatttggatattttctctaacgtttaagaatatatagatctacctgtagagggtggatttttgtcaattagtctttataagataccaagatgaagtgtattaatcacgaaacaaccaatcttgattagttaattagtctcggaaaaatagacgttccgcgtagtttttcaggaaagggaaccaaaaaagaagttaatgcaaagttagacaacgaaacgagatacgtagaaaaaaaaaaaaaataatttggaatttacggataatcggttatacattcatcttgaggaacaatgtacgataatttgctctatcacctgtcataaaacgactttagtggttgttgttgttgttgttgttgctggttggatttggtctggttgtatagttaactataaacgatgaaaccaagaagaagaagaagaaggtgtgcagaatagagtttaatggaaacaaaccaaatcatatcatatcatttgatattactagatccaatctaattgctattctcaactcaactaaaccaaatttagacagaatatggaaatatgacaccatctctctctaaaaaaaaaacggagaacattcttagaacaattctcctaacgcttgattacgcgcgttgtcgtcgtcctcttccacatacataacttctttaaattaaaaaaaaaaaaataagatgataatgaagatgatgatttaattgcagattgctgtcaaaaagcatagacaaagaatagataaacaaaatttgtctgtaatacatactattgtgggaaccattacataaccattccatttaggtctgtaggtttgaaacatatcagacttaaattcgtagttgtaaaataatactaaaaagtaataacaataacaataacaataacaacaacaataacaatcatctgatttgaattggatgatttcaattatagaacaaggagacaaaataagacaacctagtaatagttaattggtaaataacatgaagaattaaaactttaataaatatgaataaataactcgggggaagaggaagacaagtgaggtggaaccgaaatagaagaagaaaaagaagaagaagaagaatatttgccggatataaaaattgattggcacaataattgattgattgattgattgattagtcagtttgaaattttaatctcttagacaaaattgctcactttctcactctttggagtgtgtctctaatatccgtgtccgacgtaatgagtaagcaacagacatacatacttacatacacacgcacacggatattatgcttttaacccattatgcatatacaatgagttcttttcttttcttttcttttttttttttttttttctcttagcaaaagaaagaaaaaataataaatttggggcagtctagatccgtccgttttttttttgtatttttgctgtcacacactctttttctctttctctctttaatacttacagccgatattactcactcactcactcacttactcatattcacccgcaaaaaaaaaaaaaaaaaacaacttaaactaaataactaaacaactaaacacagacaactcttactaatggtgttgccaattataaatatttgattaaattccttcttttttattttgggattttttacaacaattaccctcttttttcaaatatccaaatctaaatctaaatcttttagattattaacctcttttattaactttactttactttattcacacattgactccactactactactactactatcaccacttctgcaattatgtcgctgctgcaacctcaaatgtcttttgctcaaacttatatattagccagcaaagttagatccaaattaactagagaagctcaatctcctaaatcttcattaagaaatttggtggttcaagctaatatgttggataatattatggattatattagtgatgaaactaaaagaagaactagtgaaaaattaacttccaaaaccaacacccagaagagttctagtgggtaccttagtcctgaatcttcaatggttcaatttgctccaactccagttagacaagcttataaaacttcaattactgaatatgaaattgatagtgattcatccgatgatgatgaagaagaagaagaagaagatcatgaagatgataatgaagacgattacttttatgaagatggtcaaaatgattacgatgatcttgatgattatgaagattctgttgttatggaacaagatgaattagctgccattaaaggtgtttactacgaagaagatcaagaagaagaagaagaagacaatttatctgaaacttcatcaatttattctaattcatcagattctgatttagattctgattctgatgaatattatatttattctgattccgatgaaatcattgaagaaaataatattgccatagaagctactattcctagaaatttcaagagtttatcgattgtcccaccaccatcatcaacaacatcatcaacaacatcaacaacacagtcgccattgccatcaattgtacgttctaattctaccccaatcaccataacatcattgcatacaattgatgaacaacaagaaattgaagaagaaaaacaaccagaattgttattacatgaaaataatcaaactatagattggaaattgaaaaatcataatcatccacaaagtttatataaaaatcaaaacatttctttagatcaatttttttaaagaaaagattgactgacacgatatggacaggcttatgattacgattacgatttacaacttgttgattgatgattacgacaattaatgttttttttttttttttactttcgatgtttatttatttattatttcgttttcgttttttttttaattttttttttttatttctacggttttatttcaattcttttagcaatagttttacccatttacccattttatagaattttatacaataattaacgttattttttattattagacttttgtaaatcattagagaggggggggagaagagaaagtatatactgtgttaatgtaaaatatggggtcgccataaaatgaacagatgagattataaagagaagttttgataaaacaagaatttatacgttagagcaagaagattttgggggaagaatcggaaaaaaaaaaaaaagagaaaaattcagtcctttatgcatgcgtgcgatgaatggatggatggatggatatgggtggggatcggtaattcaacagccggaccgaaattaatccatctggggcagagacagagagatcatggagtttgaaattcgggaattggaaattcggaaattagtaattaataaatatcttgttgctatacattccaaacaaatatagatttaaaaatcttttttttacaatagcaataaataaaaagaacaaaatatgagagggagtctatacaaaattaagaatttgttggttcgatttcacaactgaaatcaattatgcaaacgacgacaagcaaaaaaaaaagaaaagctggtcattttgtatgttgttgttgttgttgttgttgttattacaaggttaatctagattgacatagccacaatccctatctctcccatattattataaaatatttcttgggtgttctggtacgatttatatatataaaagggaaaacgagagtaataccaagatttttctttctttcttccttcctttcttcctttcttccttccttccttcttctaagctaaaaaaatatactggtcatcatcatcaaatgtatgtcaagaaaatcaaaaatcgacacaaaaaaacataaaatattcgagtacaaaaataagttatcccacataagtagaattgagcatgtatgcataagtggtgatggtggtggtggtgtagtgttttcttgtaagtggggatagatagatagagaagtggctgaatagttattgttgttgttgatgttgttgttgttacagatacattatttgatgactcatctccgtggtattgtcaacaattcaattcaattcaatgcaattgcaattacatttcaaattcaacttgcatttacgatagtacgattagaaacatttcttgttaataaaataagattgacaggttaacaaacaaacggggtgatagcacattcgatggaaattattagagagagagaaaaaaaaatataaagacagaaagaaagaaatgtctccaagacaagacaagacaagacaagataacaaaaacaattacttacattatgatgaaccatgtattaacccacagaggtagtttaatttccatccatcaagattagcaaattacggataataagagtaaattgtaaaataaacagcaagtatcaaaatgagtcaatgaattttgacaagacttttttatccatccaaatgacaatattttttttttttaaacaaatcttgtctatcacgacgtttttaatttcttgatttaacaattattcattcatcccaacaacaactttgctcttcttaaaatctaaatatagaatagctgttttccttttcttttccttttccttttcctttcctttcctttccttaaaatggtgggaaatattcttaattttgtgtacgcttcattagattagatttgacacttttattttcttattttaccccgttgcattttatatcccaacacacacactctctccacacattcaactccacaaatcaagtcaataaattttaaatctgtcgatttaattcatgcacccaactgaatcatatttatctgtagttgaaggctcatttatctgataatgaagccaaagccacatagattttgcatgatcataatcttacagtaagatatttattcttggttgataatcatacatacatacatacatacatacaacaaataccagaattgtttattagagtaaaatggtgaactacctaatagattcatccaaaagatattgcaatcattaagaatttgtaatacagaaaaaaaggtcatttctggagataataaacattgcataagcctatgaatcgtgactctctgtatactttggggctttattacgtaccggaattataattctttctattatttccggttatccaaaaaaaaaaaaaaagaatatccgaaacaagttagccatccacaaattattgtcccaaatccttatatatctacatatccgataaccgataagcttacaattatctccattttcatttgttttcggagtataatctagtttctgggggtagattttactgttattgttggttgagtaattaattaattaattgattaagttagtaattaattagtttatttctggtaactaaatatatgttgatgtacatggcttatattatagtatatatgtgttattcgaaatttatctatatcatttatggaaattgaacttatccagaaattttggtaaacgacttgttattcttgacagtaggctaccagctaccaccaaagagaatgcaattattaatatctaaaaaaaaaaaaaaaaactttcttatagtcttttaatcccatcaacaatatctttctcttgttcttgaatagtctgattctctccttcttcttcttcatcatcatcattttgattagctaaacctttttcaaatatttgtttcccagttaatttccctttatgcatattttcaaatctttgtttatcatataattcatatttcatttcttttcggaaattatttctccaatttaaccacagttgtttagtaactttagtaccatgaaattttttttgttcatttaattctttaattttttgttgttcatcaaattcacattgtttaatgtttaatttttcattgaataaattttccagttcttcttttaaaatggtgattaaattgaaaatcattggtatacctaaatttaattcactttcttctaataatttattcattaatgtatcattaagatcagttttaggatcaaattcaatggtttcggccatatttaatgctaattttaaatctgcattttcatcgtcatcgtcatcgtcatcactgtcaccttcatcactgtcaccgttatcatagttgtctttatcttctggagattcagctaattctatagataattgaggaattacttcaggataagtaggaggatatttaacaattaaattcaaactatgtttcctttttgatggtgtatctaaatctattcgaatgatgaaatgagtattattaattaaagtcaattcatcaggataaattgattgtaatacttcaatctcttgagcttgttcttctattggatccataattaagcaatgtacacaattatgtgtgtgtgtttaaggcgcccttgtttgaaaaattttctctttttcttcttcttcttcttcttaggatataagacacgcacacatattagttagtgtcgtgtgaaattggtcagaaatgacatgttagttagttagttagttagttagtttatactttatcaacttatccctccccccccccttccccccccttccaaaaagtatttcaaaattgattaatacatggttagattttcaattaataacttttcttaagaaaagtttcattttgtttgatctattttgacgatctaattattgttaatagttaaatagagtcggcagttttgtaggaacttccctagaaaaagaatacatttgcaattaaaacacaacacaaacaaaaacacaaacatcaatcaatcaatcaatcagttctcaatgtaagagaaaaaaaaaaagagaagccaaaaaaaaaaaatcatccttctttttaatcaacaacaacattatcaagttttatctttatctcatattacaatattaattccacacacttcacattttatatattacttatatccacatataatacaggtatattggtatcttttttttaggtgtttcacattattctccgttcactcattcattcattcattcttgagtcttttttttttgtcttgtttgtcctgtgtgtgtgtgtgtgtgtgttgataaatcacctgaaacatatactatttaatcatttgttattcatcattattgtccattttgaatagtactggttgtcatttttttgtacattcatatatcatccattaaatatcgatctaaaaaaacttttttattgaatcatttgattttaacatatattttttgtatcttcaaggacacaataatttgaattttattttaaaaactactttttggcataaagtgtcctaatcattaacttcatcctcatttacatttatcaccagcccattattttggcattgcattacccttttttttttgtttttttttgttatccttctaatttatcaaggaaagtattaatattatttcatttttatcattttggtttttgttttttgttttttttaatgacaagtcatttcccaccaaatacaaaaataaaagattttggatatcccgaaactcatccatttcatattggtaattatcttttaaaatctaatggttcaatatcatcatctcctacatcatcaacaacatcatcctctgcatcatcatcatcaactacttcatcttcagcattcatatcaaataaacatggaaatcatcaccatcaccatcaccatcaccatctacccaataattatatgacaaattcttcccaatttatactgtccaatgattataataatactaataatatcaatgacgatgacgacgatgacgatgataatgataatgatgatgacattatagatgacgattatgatcaagatgaaattaattgtaaagcaagagcaatatttgatttttctgccgagaatgataatgaaatatcattaattgaaggacaaatcatttggattagttatcgtcatggtcaaggttggttagttgctgaagatcctatactgggagaaaatggattagtcccagaagaatatgttgaaattatgcaaaatcttgataataagaataagaagaaacataagaataagagtataaatattaatggtgattatcaagaatttggtcatcaatatggaaatgcaagtaacaatcaagatgaagatgttccaaaaaggtttttaccagaaatatttaatgaccatatacaccaagatgatgatgatgataatgtggattgtgatagtgaatgggtagatactgattatgaagaagaagaagaagaagaagaagaagaagaagaagaagaagaagcagaggaagagcaggagcaggaaaagcagcaaccacaagaaggaaaagaagaaccaaaaatggagatagcgaaacttgaacaaccagtcaataaagaaagtgaaatcaatggtgaaacaataacaacaactactgcaacaattactacaacaaccactacaacgattgaaaagatcaatgctattgaaaagaaattaaatgatgttgaaatatgatataatgaaatttgtttatttttaatgatgttttttttgggagaggagggggggggtccaatattagccagcttatagggacaattaagttatattaatgttgattacgaattttatcaaatgtttttatactttcataccaacagagtgtatgtgtaaatgtatagaagaagtgtatatgtattttgtattatcaataaatcgaatcaaattaaatttatattcttcttcttcttcttcttcctccgttttttttttttacaataacaaaattagaaaactataaaaacctttgtaataaaaaacacttttcttgttcttcttgaattcatacattatagtccaatttcacttgccattatagatggttatggttataagtatttatattatttgattgaatcttctttccataagtatagttaacggtagttagttgataaaaatttcctttgctttatcacaattgttgttgttgttgttgttgttgttgcaaaataaaaaaaaagcaccaagactgaatccaaaagtcaaaaacaaatttatgcctttcaatatgattactcagattctattataatcatttttgggatttggccagtgttggttgcaaataccaaagtcagtatatacgtgtcggctcttgaaatactgttgatgctactatacagggccaggaagggttcggccaacagtcaacaactaaaagagctcccctcagctctaagttggaagtatatatatatggaaacacaattaaataaagctaagatattggtaagcgtggaccaatggatcagtcttacggtgcaaagtcggatttgacactcaattccattttacgtaacagaaacgtgatgatgatactttgggtgcgtagtaaattcatcattattgttcttcaactggaaaaaaaaaaaaagacgcatcatcattacaaaatataaacaaacacaatcatcacatcatatcacatcacatcaagcaacaattgataatgaaactagatagaaatatatgatcaaaatgaaaaccaacgaagataaattaataacaaatgacaatctaatagagagtgtgccgtccaatagcaataccaatagcaatac

SEQ ID NO: 660 - protein, 63 aa, Candida albicans
TTTITTSAIMSSSQPQMSFAQTYILASKVRSKLTREAQSPKSSLRNLVVQANMLDNIMDYISD

SEQ ID NO: 661 - DNA, 513 bp, Candida albicans
atatatcaatgattatgatttggattgaatggatagtagccaaaatcccatcttctatctccatcatcaaataatgtttctttttcatctattatacattctgacaaataaactatcaaggaaatatcaaatactaacaaatcgtttgttttttttagttacacggtgtcaatttcaaaaagagagctccaaaagctgtcaaagaaatcaagaaattcgccactttacacatgggtaccactgatgttagattagacccaaaattgaacattgccatttggaaaagaggtgttcaaggtgttgaaaacagaatgagattaagaatttccagaaaaagaaatgatgaagaagatgctaaagaaaaattatttgcttacgttgaaccagttattgtcccatctactaaaggtttacaaaccgttgttgttgaagatgatgaatagatgatttgctaaaatatatttatatgagttagcattattaatgtcatttatttagggggttattttaaat

SEQ ID NO: 662 - protein, 93 aa, Candida albicans
LHGVNFKKRAPKAVKEIKKFATLHMGTTDVRLDPKLNIAIWKRGVQGVENRMRLRISRKRNDEEDAKEKLFAYVEPVIVPSTKGLQTVVVEDD

SEQ ID NO: 663 - DNA, 5975 bp, Candida albicans
  modified_base (31): a, c, g or t
  modified_base (1998): a, c, g or t
ccctattcatctgtctgaggttttaaatgtnggagatcataggtactaaatgtgtgcccattccaatgcagatggggactcgaactttaattcttagtaaaagaaaaaattatatcgcatcttgatagaagattctgatgcttagatttttcagaaatcgcaatcttcaatcgcgtcatatcccaatttattcaagaagtcttacttcaaaatacaacagacagcatggtatgtatagacagactaatcatttaaaattgaaattgattatgtattggcaacaaatattaacatttcatttaagccaccaaaaaagaaaacggagaatacaagtaccattctcaagttgaaaagatatacatctacttttatattaacgattgaaccatcacactcattagaggatatcaaatatcaattgtgtaatattatcaacaactcgggaggattacctgcaattcaagacctggaggtgaagaacgaagatgaagaagatattgcagtcccaaaatcagaatacatcgatgatgtggatgaaatcaaggaagaagtacaagacgagtcggccataactaaggtactggtagatgatatacgagtggcctatccaaaagattcaactcagccttattccaataactggattgaattgagtgaagatagtgatattgctgaattaagtttaaaggatttcgatatattggcttttgcatatggttcggaagaacaaattgaaattgttgaaccagcttatgaagaaaactaatttagaaaaagtataaatacgaaacaagtctatagttttacatacttttagtatacattgatttaatgaaggtgaagcaaaaaagaaagaataacaaataacaaataaaaacaggttatcaaaagaaatgaacttaacatacatgtacaactaatgtttctttccacttaactttctcacaccaccagagtgtgctcttgatgtttgtgagtttccagaagcaatcctatttttggatctggctttagacacgcgcaaaacattcgtgggggatgtacctggtggagatgataatgtttcattgactgtttttgttgttgttgtcttgataatatgaattgattgctgactagatacactgttggttgatattgatctcaaaactctccaatcagaattatcctttgtttttggtgtcactgagtcataccttgctggtgagctttgaattatatcttgcatagtgttttcatcgtcagaattgttcaccatttctacctcgtcaatatcttcagagtcctcaaaatattttcttggttgtccaggagactcgataggtaccacagtttggattttagatgccaaagcaccactcaccttacgtcttctaatcggggtatttattacagaagaatcagcaagtggagatgtcaattgttgttgcaattgcaatctttcttttctttttgcctcttttagtctttgtttatagtcttcataagagcacaatgggaacaagttgccaattaaaggatcgggtctattgtctactatcattgtatgtctccagcttctaaaatcatcgtggtgcaagtaaagccaatgttgttgaggaccaacaaccattcctggtctgatcattctcatgtacgcgatacattcgttggctgtaaatccatgagtgtatatgagatgggctccaatcaaacaaccggttcttcctaaccctgctttacaatgtactgcaatttttccacctttattgataatacactctgcagcaccaataaatttttgaacgtattccaaagtaggacaagttccatcatcgaaaatcatatcaatgtgcttgatatttctctttgtaaactcttttgcgtcgtataagtgagagtttaatctcaccacaagctggacgttgttttccacgaagtactccaaaactttttgaaatggttcgtttaatcctcctcgcttgctttgttgaggagatgcaaatgcaatgaaatctntggatataacgttaaaatctccttggtcgactctttcgtactgttcatactcgtctaaatcaaatttggccaagtcaatcatacctctctctttagctctccacatggcatacacgacatcctgaatagttatttcataatccgcactgctatatcctgcgtctctgaaagcttgtaaaggtggcgtgatttgagcaataggttgcaaaacttgatgaggagcccaattctggagcaatatcatgtaacagcatagtaaacatgctaaattggctctttccttaggggatgtcgaactatatatcacgagtcccttcccttgggttgagtcttcgtttaatttcttgtgtaaaagaactgcaaaacgatataaatgcccaatgttcaaaggtccgaaatccatgtaaaatgcattatatggtaatgcgtcttcaactgtgaaatatgccaaatcttctgtatcccttttgtgatgatcataagcgccaaggtatattctatctgtaaatggaattgttagtatataatgttataaaaggtagaacaatcaatttgaagtagattttcccaacatacttttaagaaactctataagaggcacatgaaccagtgaactatgcatcggaaaaggtgtttgtgattattaggtagtttagaacggtatggtagaaacaaacgtgtttttgaatgaaagacaaaatgtacttatatgtagaaaatacaaatgaatgatagacgttgagttaattggataaaattgaagacataaaatagaaattcaaaaaagatctcttccatcaaaatttatgttgtttcactttgtttttgtttttgttttgttttgatttcttttttcttctttgaaatcgctgaatggaagcgtactgttgttgttgttttgtttttgctgaatcgggtaagatttgaatattgtgcactactgtagcaaacctcaatccaaaaaaaactccaaatctgattgtgagaaatcaaaattttaggtgtattaatccttcatagcaaaggaaaggaaagccatggtacgttcagcataactatttttataaagcttgttcgctttactaaccggaccattgatgatagtcatcttcgttatatacattttctccagaaacactatcagcattaacaaagtttagatttcaaagtgccaaagtggataaagttcaagctgttatatgtatgtattaaaacaatgcctacaattttgcgattgtttaattttgaatactaacatgtcaatgttagacacgattgacaaaaagagtcatgaaatcaaacaagaagatgaaattatagattccatagaagaattggttgaggaattacccgacacctctcctagatacgtcatcctatcatatcccttcaaactggatgatgggcgattgaaaacaccattagttatgttatactggatcccaccaacaagtggacaagaaagtagaatgctctatgctggtgcagttgagcaatttagagataaagctggagtctcaaagtacgtattacaggtaattctgccttttagctgaacacattagtgtactaacatccatttagattgatcaaacttgaagaagaagaggactttgatgatttgaaagaacaattgatttagagggggggttaacagttctgtattataaaaatgaatgagcttgtaactggtctatctatcatatagctctccttttagtgtataatctgattcctgcatatattgctactcatttaattttttgttacaaagtcgtgtgcattactattctgtagaaatgagtagagaaaaaaattttcagttgttcttcctctttaaaggaaaaaaaaaaaattttcatttcctttctttctcaatcttcttttcttaccactagtcaatcaataaaataaatcagtcatcatgggtcgtatgcattcatctgtatgttatcaatcaatcagtcactaaaatcagcatcacatactattaacatgatagtgggaacaggagttttaaagaaaaaaatggatttgtttggctttaacaaatgaagaggtcttgcctaaagtaaacaattcgtctacggtcgacaataaacagtacctagaattgttactatatacgctttaggtatttgatacttttctttgattattgctagggatggagaggaacactgggatggactaatcgtctcggtgtctcttctttgtcttaaaatttcaaatctaagtaatttcaatttacttttttctaatatgacatgtcaaatattgctccagatgttaattggaattttcttttctttgcattgggttaagttttactaacatcttgttgtttagggtaaaggtatttcctcctccgctcttccatactcaagaaacgctccatcctggttcaaattgtcttctgacgatgttgttgaacaaatcatcaaatacgccagaaaaggtttgactccatctcaaattggtgttatcttaagagatgctcacggtgtttctcaagccaaggttgtcactggtaacaagatcttgagaatcttaaaatctaacggtttagctccagaaattccagaagatttatactacttgatcaagaaagctgtctctgtcagaaagcacttggaaaaaaacagaaaagacaaagattctaaattcagattaattttgattgaatcaagaatccacagattggctagatactacagaactgttgctgtcttaccaccaaactggaaatacgaatctgctactgcctctgctttagttgcttaagaaggttagttatttgtatatcttgtcttttttttatatatataaacatgtatattattcactaattaatattttatatcaataacgaatggaaagtaatcgttttaaaatgatatggttctcaaaaattaattgtagtgtttgaaatagcatggcttgttgcaagaaattagtttgaaaaattataagcacccaaaaaaaaacacttctgaagagttttcgtagaagactttgaacattcttttaacactcaacacaattatggaagccatatccgatagactatttaatgagaatgcaaacacgatagaagcagggaatgatgacccatcattattgactataatactagatctttcaatgaaaggatggtataacatcaaagaaatgatttcaatacaagatatcaccaaatcattactagttttcttgaatggacatttgtcattaaacaatagtaatcaagtggcatttttagtgagttctactatgggttctaaatttttatatcccgatttaactatggttggaaaccccaacgtgagtgaacattctgaacattttcctgacatgtatcgactgtttaaaatggttgaccaatctgtgctacaacaattgaacgagtatattgaagagattatcaaattcgagacaaggaatgaaaaaaagggtttcaattgcttgactggagcaatcagtatggctttaacgtacacaaatagaatgttaacgttggatcaatcaatcaccaccacaactgctgctgcaatgacagcttctacgcttgaaagtacatccaacaacaataatactagtggcactagtggatcatctagtacctcatctagcacatcgatgaaatcaagagttttgattgtgtctgctaatgatgatgacgatcttaggtatattccattgatgaattgtatatttgctgcccagaaaatgaaagtgtctattgacgtagcaaaattgggtcataacaactcatcctacttacaataagcttctgatgccaccaagggggtttatttacacattgaagatccaaagggaataattcaagtgttgtcaaccgcattttttatagaacccaacctacgaccatacattattttacctacaaattcaaatgtcaattatcgagccagttgtttcattactgggaaatcagtagatttgggatatgtgtg

SEQ ID NO: 664 - protein, 143 aa, Candida albicans
GKGISSSALPYSRNAPSWFKLSSDDVVEQIIKYARKGLTPSQIGVILRDAHGVSQAKVVTGNKILRILKSNGLAPEIPEDLYYLIKKAVSVRKHLEKNRKDKDSKFRLILIESRIHRLARYYRTVAVLPPNWKYESATASALV

SEQ ID NO: 665 - DNA, 2002 bp, Candida albicans
attcctccccaaaaataaaaataaatatggatagaattcctatgatacatattatattaccaacttttcttttctattcttcttcttctctttaataatagttatttcttcatgcaaattttcattttcattctaacttcttggtgttttctttattgttgtgattgtgtatgtgagtttttttttcttctaaaaagccgtttactttcttctgaatgaacaaccttcagtcaatttagctttaccaccagttggggtacacaaaacagtagaacaagagtcacaagtgacagcagtttgagcgtgactgaaaacagtggtgatattaagacatccttgacatttaacgtccataaagaaagatcttggttgttgaactaaagttttcaatttgtgttgtttagcttcagtggctggagatggatgtaataaatcttgaactaaaacctatacgaaaaaaaaataatagttagtattacatgttttatttgaaagattgtgtctgagttatgtcaatgtgggaaaaggagggttatattcgtttcgatgatttcagtaataacacatggatccacaccaaaagtatatttctttgacgttttctgaggtggtaactttcatgctgattctcttctcattttcctgttcttttaaagtagtagttgatattaatatgttgatcctaattcattattcggtagtacaatgttttctgatttgttaatcatcattccgtattctatgcttcctcttattcaatttttatttcaattcaattatatcttgattccagtaaaatagtatactcctatattatgatattctgatcatccaggaatatccctccataactcatggtaaatctaatgaacataccattgttaacttgtttctctaatatgtataattcaaaaactgaaatctattgaaaactgaaaattttttttttttctcttttcttctttccaattaggtttcgtgagttaccaaaaaaaaaaatgcgatagtatggcaagagagaagaagatttctcactatacgcagcatattgggggaagaagttagtttttttttgtttgtgtgtgtacaaatgtacacttttcactcaaagcaatacatcacgtgcaaacaattagggctattagggctcaacattttttttttcaattgtgaaacaaccaaaactaaaactgcaaaaagtgtcaagaatagcttttcaatggttgagccaatattttatttgatcagtaaactcattttaagcagagaatactgtcccaaggttgaattcttctactaccaatttgagatgtgacttattggatatatattttgcaccttcctacagtccacattctacacaatgcctacaaatgaaaaagtactcactatgatagagtattctgtttcagcactactaaatatgcaccagagtttacatctatcgtaattgtaaatctttatgaaattttatcaaataaacagaatcagtttttggttggcaagtttcttaatttgactggtctcatcttggaatattttttattctaaactatgcttaggtactgatgggaaaaacccttcttcctgaattttcaccgctctttgttgactatatttctttttttgataagacatcaatctatttttataaatgtcttgattcaattgatacaatttgaatttaaactccaggattttcttacttgtttcttctaattcttttgtaacatcgaccaattcttgtttcaatttttcatatttcgactctgtagatttgtccttatccttatccttgcccttgtctttatctttatccttctgtttccaatatcctgccacagtgttccaaatgtatggtttttccgactcaacatctttctccaattttgatttcttgtccgtgagtgtctgttttttgtctagtagttcagtgtattcttgaggatgtatggcattggcaaattgatcatctaataaatgttgtggacaagtatagaaa

SEQ ID NO: 666 - protein, 81 aa, Candida albicans
VLVQDLLHPSPATEAKQHKLKTLVQQPRSFFMDVKCQGCLNITTVFSHAQTAVTCDSCSTVLCTPTGGKAKLTEGCSFRRK

SEQ ID NO: 667 - DNA, 8496 bp, Candida albicans
ctgaatcaacattagaaactgaatatagtaaccaatcaaatcatttctttaatgaattagggaaccaattattagacaaggacaacataaaagtggttaagatcccgaaaaatgattcaatcaaaaataaagttgaagccatattcaaatctattgaacaagataaactaatacttttaactggattatcgaattcaattgccaaactaatatgtattacagaaatagtcaaacaaaaacagaatgaacaacaacaacaacaacatgaaccatcacagaaattagatcaatataacaaacttctacatattgatagtacagtaaatcctagttataaacccataccggagaaagaaaacaagaaagtcgatacaaaacaattggagaaagaagctttacaagaaatcaaaggtcccaaaatctatacattgcctgtgttgtacattgtgataggtaaacattcaattgtgtcaaatatagagttagttaattggacaaaacaagacaaataatatgtaaatgtatagtatatagcattcccatccaatacaattcgagttagagggacagaaaagagagacggaataaacaacatactataataagtaaattgacaataatgatgtgaagctggtgggtagaggatggactgtttttttttttatttagccttgggtacacatcttgtaatctggacactacctaccaattggaattctgcttttattgtttaagaaaattctattgggggtagtgtggttttgcaacaaccaatgaaaattcagtgcttacccaactcactcactcactcaaagaaaaaatcgtaagatggcaggaaaactctttaaaggaagaaagaagaaaaaaaaaaaaaacacgcccactatcaagaatacttcttttcatatccttttacttattaaacatattcatacataatgccagtcgatccagctacttttaaattcgaaactccacaatttgacccaagattcccaaaccaaaaccaatccaaacattgtgctcaagcctacgttgattaccacaaatgtgtcaatgtgaaaggtgaagaatttgaaccatgcaaaatctttttcaaaactttcacttcattatgtcctttggattgggtcgaaaaatgggatgatcaaagagctgctggtaaattcccagtcaacatggacgcttagattttgaaaatcctttccttttgtttttgttttttaatgataactttttgttttacattcatattatgttagttttgattagtccttttttaggtgggatatatattcttttaatttcttttttttttataaagaaaagcttttgtcattatcgtttttgaagtccctccccaccccgtcatttttggctttattttttatatatacacataaatattcccatcccactacatgtcgattatatacaaaaagagagaatgaaataaatgataaaaagaaaagaatattgaaaggttttttttgaattcttgataatgtacatattctatgaagaatgaaatcaccagaaactatcttcggaccaattggtaggcttgctagttgattcactagcaaacaaatcagcatacgggtcagcattttgtttcttctgatattcgtattgtttacttaactccttggcctctctttcttcttgtttcctctcattagcaatttctttgatcaactcatcctgtttgacaataaactcatcaataggtacttccttctttgtcttatttaacttattgatgatagcattctcttttttcacaacattaaaccgtttcacaagcttattgttcttgaaagtgactgtacctatatccattgacccatctgtatgcaaattctcaaccggagtatatatgatagacacattatttagtttattaccctttattgaattagctttagtcaactgtcctaattgattaagcaaaccttcgtctatttggaaactctcaaaagatttgaaatttttaatttgatctttggtcaattgcaaatagatatgtgctgacgaaagcttgtcaacatgaaaccaaatatttttgggatgagaatgtttaattaatgggtcattctctactttatctcttcccatatatatggtagcttcgtccgcttgggaatcatcaatagcaaaatcagctaattcatcgtctttagaggttactttcgccgtaaagtagtacaccatgatgggaattgggattgaatcaaactaaacaagaaaatgaagtgggattgaaagaaaaaaaaaaatagtacagaataaacataatgagacacacgatttacagacatactcacattacagtgataatctacctacaacatctagataatcactgaaacatatccctcgtttatagaaagaataaactcgatgatcgatttttcaatttctacaagcttttttgattgccatacactatatgccactccttactgagaacctatataaatctggtagctccgagtaaagagaagaacttgtaagtcacaacaagtaaactattaatacaataagcaactcactttctctttctatatttcatcaatctacattgcaaagtggaaactattagactactagttgctaatgagctttgtgttgcatatacacatctattcatgtgtaggtatttaattgttaacatatacactactcctttcacttcacagtaaaattttttcttcttctttgattttccatttctttttttttggccactcgaaacctaaacccaaaataatacagacacagacaacaaccaaaacttgttttatttgaatcaattcattaacaaggcaattactaaatacaagaagctgcattagagtatatattgactactgattagatcttatataccactacaacaatcaaccaaacaaataaacaaacaaagttatagatttagatcattttttttattttcccaacacaacgaggaggactttactaattgccaattttaatcctttttatccgtttgattgatttatattcctatagttgatcaccacgaagttacatcgtccccctcttcgatctatcatcaattgaaaagaaaaaaaaatcaccttgaactaacacctcaactgtgagtttttaatccatcaaattaaaaatttattatcgtgtcttcatcaccagtaaacgctagcccactgggccaacaccaacaaataatagaacagcaagtcgaaaaagagccatcttatagaatagagaatcccgaattaaccaaagctattatcaatcaattatcgatattattaacaactgctgatcacgataatttagaatcacattaccaacaaatcagattcattttagctaaacaagtattaaaccctattgttattaacaattattacgaaaaacttgttagttttattagatttagcgattattctaataccaaattaacatccattgaagaattattttctagagaacttgaagttatcacaaaagacttgaaatactttgatttattgtttattcatttatccaagttatttgacaccaaagccattgatattattgaatttgtaaagagatttaagtgtgatccaatcttatcctttatatttttagtcaagcttgctgataccacatctcacgaaaaaatcgacagttacataaaagagaattccatcgatttattaaaatctttaagatctcaagaattccctgcaaactacaactgggtattattattagattgtatattaaacactccatttttcccattcattcataagcttttaacattaagctcgttgaaagcatttaaatcaactattgaacccgtcaacaaattctatcaaaatatattaaagatgtcattcaaagaattattaatcgaaattggtccagaaaacttattaccagaaaaattgttaccaagcttattgcagatcaaacccaacgaaattgatcaaggtatagcattaatattagctgaaatattgatacctgggtctcaagggttatcccaaggattgacttttgccagtagcttgccaggctcaaatgccaaaggcgctcaattacaagcatgtttcaaatctattgaaaactctgggaaattcaatgtcaactggtacgaagtgtttaatcacgtgcatcaatatttatttgactcgtcacaaagagatatccaaccatcagttggcagcattacccagtttttatcgtcattagatttcaaacaagaaccaatagatatattcttgaactacgaatggtggttcaataagacgttgttgtatatattgcactcactggatgcatcccagggtggttatgatatatcgttgctgcctaatttagcttattgttttgaggaagataaaaccactccccaaacaagaagaaacattttgaaatttattaatgtgggtaaactagaaatccaagtgataaccaaaatacaacagcaacagcaacagcaacagcaacagcaacaacaacaacaccaattgagtgagcaagataagaaactaaacgcgtttttaaatcaattgtttgagcatgattatcgtgtgttcccagaatatattttggccgctgcattaactgtcgttgagaaatcccaatttataaatgacttgattgacacgttgttttatttgttggtagatagcgctagtccttcgttgcccaaagtagtacgtttactcaaggaatcgggacttgccgctatcaagttggctgattactataagagcagaaaaaccattgatgcagcagacaaagtgttgactttggcatcaagttttggattgacccaagaaatattggatatcttttgggcatttgatctgaaaattgctataaaaattttggtagaatccagtctttttggatatgactacaaatctgttattgactccaagcttaaagatccacaggtcaaaacatccatctatcaagcattgtgtgaagcattggacgagcgggcccaaaaagattatgaaaggggccaacaggttcagcaagcacaacaacttcaacagcaacaagcgctcccacctcatcaagttttgaaaatccctactgtttattatttacttgaaaaaatcaaatcgagtaatggagttgttgatgctaagaccttgagaaatcttcaattattgttgttaacaacctatccaaggttaatcaatttcggaaatggtcatgatgaagccattttggccaacgaagagaaatctccattcttcccaccttctgttgaaatggaaatgaaagcttattattcgaaaatgtataacaaagagcttgagattaaagaaattgttgacatgttgactcaaatgaaggccagcgatgatctccacagtcaagatgtctttgcatgcatgatccactctttattggacgagtataagtttttctcagagtatccattgtcagcattagcttcaacatccttgttgtttggtgcacttttagaaaaggatttgattcaaggtacgactttaactgttgcattgaattttatttgggaatcttgtaaccaaccgcaagattcacatttgttcaaatttgcggtacaatcattgtacaacttcaaatcaagattgcatgagtatccaatttattgtaaacacttgttggaatgtcgttcattatctgcgcatgccaagatgtaccaaatagtgaaggatgcagctaatggtattccatgtaccactggtgcagctcctactcaaactaatacaccagatgttggcccaaaatatcagtctattaattatgttgatagaactataggttatgcaacccaagaagaaccaccagagtctatcagagataagttattattcagtgtcaacaatatgacaggtgaaaatcttagattatctgagatccaagaagtattgactgagagttatttcgcatggttttcagattatttggtatcagacagagccaaggcagaaccaaacaaccacgaattatattccaagttggtcaagtcgttagcaaatccaatcttttttgagtatattttgaatgtttctttgaaagaggttgattatattatccgtaattttaaggattcaagaagcgaaagaaaccaactaaagaatttaggtgcttggttaggacgaatcacattagccaatgataaaccattgagaagagattatattgccttgaagtttttattagtggaggcgtacgatttcaactcgttgccattgattcttccgtttgtgtgtaaaatcttggaccaggctcaatattcaaaagtgttcaaaccaccaaacccttgggttgttggggttatgaaggttttagctgagttgtatgaatgtgctgatttgaaattacaattaaaatttgaaattgaagtgttgttgaattcattcaatatgaagatcaaagatatcgagcaaagtactattattagaaatcataatcctgaaccaactgcattagcaagaatgtttggtatcagttcacaatcagtgaatttggcaaatgaaatgacaagattgtctttagagggctcgcaattgggtaataatatccaagcaccattcccacaacaaattattgaatctaaacagttcccaggaatctcccaaccacagatgcaaaatgttttacaacagcaacaacaacaacaacaacaacaacagcagcaacaattaccaccgcagcaacagcttccagggcagttgccacctcaacaacaagcggaaccagctttggataccagtttcagcacgttaattgggaactctattttcactcagcatgcaaatttgcgcagagcatttcaagcatctttatctcgtgcagttagagaatgtactccacacatttgtaacaaagttgtggaaactgttgttaccaccaccaaagctttaatcactaaggattttgctacggaacgtgatattgagaaatttcgcaacagttatcagaaattggcattgctgttgtctcatgcaatggtgtcatgcaatggaagaaaagcattagttgaaacaatcgaggctactatgttgcagttattgggcaacaatccaaatgaagtacctttagctgaattgaatagtgccattcaagccaatgttggtttatgtgttgatattgttgatgtgttggtaggtgaaagtattcttgacatcatagaggcaagaatgcagacagaagtgtttttgcgtgaacatcatactgccacagctccaaatgaaccatttattgcagaaggggccagtgattactcgttgagattaccaaatcctttaggattagcacttaccggattgagtgcacagcaattgaagatttatgaacattttggagaagcaagagtggatcaaattgtacctcctccaggaagtaccggtataacacaacaacaaacacaatcattagcaccattacaacagcaacaacagcaacagcaacagcaacaaccagtatctacagtagtagcggcagcaccagcaccagcgccaccacaacaacaacaacaactgaaagaacgcattgcacaagcacaaggtgttcctgatgatattgtttcgtttgaacaattgtttactgctattactgccaactgtgacaaagccgttcaacttgtttctgaagtcacagaaaccaagttagcagatttgccaccaaaccattccattatggcggcattgactcaagctttggtgattgcacagaccaatgccataaaatatcctgagttgttattaaaggctgcacaatatgcagtcaactgtttgtttactcagacacacgaaaacccaatgagtaatgaaatctatgttgttattttagacaaattgtgtgagtattcaccttctaccgccaaagatgttatttggtggcttgtacactcatctgatcaacgtaagtttaatatgccagttatgctttcattattgaaagttcaattaatccagccaattaaattagatttatctattgggaaattgattaaagaaacaaataatccggttgtagtaaagtttgctgctagtttgttgacgaatatttttacttccgaagagatgcgtcctattgcgttacgatcggaatttgctaatacattagatgccttatctaaataccaagcaaatgatcaaagtgaagaagacagacaagcaaaggaggcaactagtacattgttcaaactcttgagtgaggcagcacccgcttcaaaccaattatttgctcaattgggttatatatttgctgaatgggtaagattgttgactcatggagacgatgcaacaaatgaattacaaattgaatttgtcaagggattgattcaatctggtatacttaataatcctgaatatgtaaagacttttttcaaagcggccattgagatttccattacatcgtttgccactgaacatgaattacgttcaagaactcaacatgaaacatactttgccgttgatacattggctatgttgattgttcgaa

SEQ ID NO: 668 - protein, 74 aa, Candida albicans
DPATFKFETPQFDPRFPNQNQSKHCAQAYVDYHKCVNVKGEEFEPCKIFFKTFTSLCPLDWVEKWDDQRAAGKF

SEQ ID NO: 669 - DNA, 15251 bp, Candida albicans
tttaaatcaccaaaaaatgtatcaatattttctgaacagatacaacaacaacaacaacaacaaaaattgtgataaatattaatcaaattgatattcattttagtagaattgatgagaaaaagaaatcaaaggagaattctcatcctggtattaaaaatatatctataactaatgataccaataaagatcccaatcctagtaatggtttaataaaattagcaggacaagaattagatttaacatttgttgattctgctaatttgagtttcccaggagaagacaaagatagatctcatatattacttcaacatgttcaatcagttacaaattccggtcattttcaaatagatctgattaaacttcaaataactattcaattacaacgtaaagaaaaatgtatcaatttgaataaaattgaacttcatcaagatttttcaaacattaccaatattggatgttatcaaatatcatcaactaaacaatgtaaaattcgtttagattatccaaataatgaaatcaaaatatatcctgtgaaaccagatattaatattaaaccaaaattaccaatccattgttttatacctggtgaaaaattatctatcccattggaaattaattataaaaatcctcatcatcatgtaaataaacaaacttatctcatggcaaaaataaaatccccaagtactgctactactgctactaatgatgtggttgctattaattgggatggatttaaagatgatgaaccattaaatttaatcaatttacaagaaaatgataatattcatacattatatattttcaccaggaattggaatcaagaatatttaaatattgaattacaaacttatactgaaaatgaaaatgaaaatggaaatgaaaatgaagaagaaaatgacaaggacgaggatgaggatgaggatgaggacgaggttgtggtttatgatattgcaacttttactataccagtattatcaaagccattttcttgtcaatatgttataactccagatttccgtgataaagccactgatatgccatcaccatttatattacctaataaaactgatcataatatgcctattgccgttagattatgggaaggtaaattaaaaatcattgatgaatataaagaatttatggaagaaagtttaagaaataaagaacaacaacaacaacaacaacaacaacttgaaattgttgatattgaatttaatattgtttctaaaaatcctgaattaatcattgatttaataaataatgataccaataatactattgaaaatcaacaatttataacaagaagtaaaagtggatttagtcatagaaatgtcactgttgttagttcagctattattaaatggaaacgtaggaatcataatgataatgataatgatgatgatgaaataattaatgaatttgaaactccagaatgggaaatcactttaccattatctgaaccaagagttttatttcgtattattgaacaagaacaagaacaagagcaagagcaagagcaagatgctaaacacaataatggttataaattacaatatattttagaaaatccaactccgagagtatttacatttactactcaattgactgattatgaagatcaatggatattcaacaattcaaaaaatattgttcccttgatccaacctccattccccgtattaccatttagtcgacattatatggatttcataggtgaatatttaccagcactggaaggtatgagtgattctaattccaatttagggtgtgggtctgagtctgggtgtgggttgggattgaaattacctaaatttaaagtatttgatgttcaatataaagtgacacttccaattgtatcagttctgaaagatatcaccagcatacctaagaatactgggaatttatattacaaaccaaaataactaaactaataattctctttgtgtttatacattttctagaaaaataaaataattacacatatatttatcaatagtgggtctggtctggtcacacacataattattgaccattaacaccaagtaattcaacttcgaaaacaagagtttcattaggaccaataattggtgggatacctcttggaccataagccaaatttggtggaatagttaaaattgctttagttccctttgaaattttaggtaaattagcaccacctttaccataattgttagttaaagaaatatcccaacctttaataacttgaccaacaccaacagtacaagtaaatggtttacctctttttcttgatgaatcaaattctttaccattagttaatttaccatcataatgaatggttacagtatcacctggcttagcaaatgtggtgttatcaccttcttgaacaatttcaatttgtggaagttcttcagacattgtaatttaatctaatttaagttaatgaaataattgcaaataatagttatatgtgtcaattgaattgattataaagtggcaattaaaagaatgaatgaatgaatgaatgaatgaatgaatgaaaatggctgggagagaaaaaaaaaaaatttattagttgaacggaaacggagcacgacacacacacacacacacacaatatttgtccaacacacgactatggcaacaaaaagattcattgccaccatcaatagcccgaatttaaagaatataatggaagttggggacaattgttatttataatctttcctttttttccaatctacaataacaataactaccatccattcctttttttggtctattgaattaagatcattttgtataatatccatcggttaactcttttttgaccaaatgttgaactattgtttagtttgttcgtattcatttttttttttttttttttgcaactaaacaataaaagatcttacaacttagtggtggttgatcttgtggtatgattgttatttctattatgatggattgaatagttattgtataatactctttcttagcagacttcaaagtaatttcttacaattgtttaacttgcgttgtaggtgataatactcactttattaagtttatacagctagaaactataaatcccagatctgtttatctaataatgccatatgcaacaaaaactgtttcaaccgtttggtgacaccatttgatgtgttatactgataaggggaggttatttagagaaagaaatctttaatatatatttagttggttattcttacttgatgatgcagcagtggcttacactaaccgcagcagcagcagcagcagcagcagcagcagcaggagtcactactgcgcacgcgcgcactccatgacactaactattaagtaaataaaataaaaaattggttaagagtaaacttatctttgaatttcatgttttccataaaagcaacaacagcaacagcaacagcaacagcaacagcaacaacagcaacaacattttcaataaacacaataaccccttaacttcttatcatttatcatttatcatttgttcatctcaaaacacactgtatctgatttcaacgcaccctttttaacttaatatgtccgatgttaaaattgaaattgatcgttcacatactgatggagctttcaccaattatgatattattaaaggaaatgtcacattagtggttactaaagccattaccttaaattggattcaagtgaaattagaaggtgaatcaacgacgcaattactgatacctaaatttaataacaataagaagaagaaagaaaaggataaaatcattcaagatattcataaagtattatatgatacaacaatagttttcccaccagataatgttcgtcaagttagtcaagctaaagaatttactttagccccagggaattattcatatccttttgaatttaaaatccctttaactaattcttgtgttaaacgtggagggatcacaaacatgattcatattaataagaaaacttttgatattatgattaataatggtaatttcaatagtgattttgttaaacataaagctcaaaagtattataaagattatgtggcgggtgggcaacaacaacaacagcaacgaccagaaatgcctgccctgccaaatgaattaccttatcatgtaactacacaattaccaccatcattatcagggatggggaattttgctaatattaaatattatgtcaaagtgacatgtaaacgatcatcattttttaaaaccaatctacgagcttttgatccatttacatttttaccattagatcttgattctcaatatcgacccatagaagaacaattggaacaatataaagaagcatttgtaagaaaagaaattatatttatgaataaaattccatccattgttggtgtagaagtaccacagaaaacacaactagtatcacaggcatcacaggcatcacaaatacaacctaaaaagcaaggattcttacaaagatggtttagttctgatttaagttataatacacccaacaataatacttctggacatatgtcaaggaaaaatcaactgatgaaatatcctaagattacaccagttaatgttccattttcatttgaaattagatttcgacatcctgcatttttaactcctgggaaactgccaacttttaaattatatcttgtatcaaccgtgaatccattacaatattcattagataaatatggtgaaccagaagaatctaatggattaggagttgtttatttacaaaatattactgtttcattaatatctacaacatctatatcaattgtggaaaatgattctggtatgaatgaatttcatatggggaataatgtacaaacaataccaatttgtgataattcttattctaatttgaaatttgatttaatgaaatgtcgtaaaaataaaaattccctgataacaacaacaagaaattccaatgatgcttgtattaataataaaccagtgacaaaacaactttatgaattagaaatcccacaaaaatattttgctaattgtatattaccagagaatttaccaccaagttttaaaacatgtaatatttcccgttcttatgatttaataataactgctaaatttagtcctgaaaagataactatcaccactacttcatcatcatcaccaacaaattccgccagtagtaatatgaaagaagttgaattaagatgttcaaatattaaagtattaagtggattacattttgctggtgctccaataactcaacgacaagctagtgtgatactgtcattaactccaccaccagcaccagcactagcaccagcagcaggatcaaggtcagggtcagcacccgtggcagaaacacaagattccttaggacaatcatctaaaagtgaatcgttcacaaatgaaggagatgaaaatttaccaacttatgatgaagtagttatagaacataattatcaagatataagtgaacatcaaagagccagaagaagatatcaagaatttggtatataagagggagggagggaggggggggaggggcgaatttatatattatagtttatatgaatgacgtataacaatcaaaacttgaattatatatattatgttgttgtaagttgttatgtcaagtagtagaatttaatctatattataattagtgtatgaagtgtggatgctaccaattaatggtctattttacactaccactcctaaatttttaagtttgctgtgtgaattggctaatcgaccaaagtacacgtcctccaatttgttctttcgctttcgcttgttcccagaggaaagaaagagaaaatttttcaaccaatccaattacaacgaatagtctattcattcattcattcattcattgacaatacttattacttttctttatagtaatttaaagaatccaattcttataacatccaactactattgaaagtttttttttttaaaattattcaatatttgaaataaaactttctacatttatttttttattttttttttttgatacaaaggaaagaaggacagaatcaacaccactactaccctctaccccttctccgctccaacttaacaatcatgtcatcagataatttttttataaagaatagaactgctattattgtgactgcattgactgcattctctgcagctggtgcttattattattacactcaacaacaatcaactggtggttctaattcatcttcaaaatcaaataaatcttctagtgaggaaggtaatacttccacttcttcctcttcttctaagaagaagaagaaatcaaagaagtcaaagggaagtgctactccagaaccaaccaattctacttcttcttctactactactactactaccaccactactacttcttcctctgacagcaaatcaacttcatctaagaaaatcaaatatccaattaattctgaaggattacctgaattaacttccgatattatttctaaattatcagaaactgaaaaagaagaatgggctatgcaattaaaagaagatgggaatcaagaatttaaaaataaaaatttcaaaaaagctattgaattttatagtgctgctttagaattaaaacaagatccaatatattattctaatagatcagcttgttatgctgctttagatgatcatgaaaatgttattaaagatactactgaagcgataaatttaaaaccagattatactaaatgtattttaagaagagctacttcatttgaagttttagaaaaatatgaagatgccatgtttgatttaactgctttaactatttatggtgggttttctaataaatcaattgaacaagttttagaaagagttttaagaaaacattcgattaaaattgttgaactgaaacctaaaaaattgattttaccatcagctgctactattggatcattttttggtgcttttgttgaagaaacagaacctgaaggaattaatgaatctcatgaaaatgaaggagttaaagcattatatactgctttacaaaaaattaatgccaacactcaaaatggttatgaagaagctgatgaattgatttctaaagctgttactgaattggaatctgcaattgaatctgctacagaattaaaaccagttttggcaattgctttagaatatttagctgcattccaatttttgaaaaatgatccagttagtgctgctgaatcaattgaaaaagccatttcattaaaaccaagaccaagagcttatgtattccgtgctttaattaatgctgataaatcatcttatgaagcagcattaaaagattttaaaactgctgaagaattggatgataaatgtcctgatattttctatcatttaggtcaattattttatttaactggtgatttaactaatgctgaaattaattttaataaagctaaagaattacatccagataatgtttatgcttatattcaattagcttgtatcacttataaaaatggacaaattgaattagctaatgaaaaattcactgaagctaaattaaaattcccaacttcaccagaagttcctaattattatggtgaaattttagctgataaaggtgatattcaaggtgcttgtaaacaatttgaaattgcttctagattacaagaaaaactcgatagattttctgttggagcattaccattaattaatgaagcaacggttatatctagagaatctttagaaaaaattggtgaagctgaagaattattaactaaagcttgtgctttagatccaaaaagtgaattagcaagaatttctttagcacaaattaaattacaaaaagatgaagttgatgatgctattgtattatttgaagaaagtagtgatttagcaagatcaattgaagaaaaaattcaagctacttcatttgctgaagctactaaaatgcaaaaaagaattaaaaatgatccaattttaaataataaaattgctgaattaatgagacaaagtggtgccatgtaaagaagaagagcctgcctgcctacctcactcacttccttccttccttccttccttcctgagaaattcttattataattaaagggggaggggtttataaacaagattggttaattgtaatttccccctttattttttgtaaagaagaataaatttgttttgtatataaaaattattatagtagtagttttttttgtaaatttaaattacttacttacttacttacttacttacttgcctattaactttttttcttttttatattatttgttattatttgtaataaacatattttatttactccattcattcaagtttatatctattttatcaaatgataagttaacccccttgtgatcatatgttatttattaaatcattaattcgttcaattattgcatcaccgaaaaatcaatattatgattcatcaacaaatttaaaacttgatttatcttatattactccacaattaatagtaacatcagcacctgtaacaaattatattgaatcatggtatcgttatcctttaaatgatttattacaatttttaaattctaattatggatcaaattggcatattttcaattttcgaggtgaatctcctggatatgatgattcattagtatatcgaaaagttagtcattatccatttcccgatcattatccacccactatgaatattataattaattgtattgatgaaattgataatttattacaagttttcggcgataagactaatgttgttgctgtgttacattgtaaagcaggcaaaggtagatcaggaactttatgttgtgcatatttgatctatcaaaaatatcataaatatcatcagtctcatagcaacaaatcattcactctagaggatattttattgatttatacaactaagagaatgaattatttaattggaggagaaggtatatcaataatatctcaaaaaagatatcttcaatattggtatgattatattcataataaacaattacgtgaatcatatataaattggttaaatattatgaaatttataaatttaaaaatcattcgaataggtggattgaaattatctaatattgattatttaaatatatcaattctgacatatattacaaaaatagaaactgacactagtggtaatagtaataatagatcaaatacaattgttaaagaattaatacaattaacaaatgagaattgtgatattgataaccatgatgatggccacgatgattattggataacttataatattcatgatttgaagattttccaattggaagatataatgattggaattcaatcatggagttatatttggtttaatattttctttgaatcatttaaatcaaatggtcatggtcatggtcatcacaataataataaggttttattcaattgggatgatgatatagatggatttaaaggatttaaacaaaagggaataaaattatttaatgaaatagaattacaatgggatgttatcatcaccaccaaaagtacagatatatatgctaattagattattctatatatatatatatatatatagaagcttttaaaaaaaaaaaaaaataatacaagatataataaggtttactcatttcaattctttaacctccacgtttttcattatcaatttctaaccaaaattgattcaatgctctttgtatagaatctaaatgttttttaccattttctttaatgatttgtatatttgatttaatattagtgaatggtttaatgattttgatttcattaaatataatgatttctgattgtttagtagatgtagttgaattattgccattaccaaatttaacatttttatctccatataatttgacaagtctattgaataaaagagttgaaatattggatggttgggtatgtgatgcttgttgttgttgttgtattggttgtattggttgtggtttataattattgatttcatgatttagtcttttatctaaatcatcaatatttataaattccaataatgtagatgcagatgatgaagaagaagaagaagatgaatccgatttattattaccattcttccttgaaaaaggtggtaatacttgaatacttttaataaatgccgtatttataattctataagttgaagtagaactggagttttgtttattatcattaatattggttttagttctaataattataatttcattagatgatgaataagtataaatttgaccaattattatttgatctaataatgttatgattttaacttttaaattaatgatttgatcaaaattttgaaatgacatgatttgtaaaagtgtataaattgtattaagtaagtaaaataaaaattgacttgacttgaattgaattgaattgaattgaattgagctgagtggttgttgttgttgttgtcgttgttggattattgatatggataggattattaaatattttcagaatcaataattaataataatcttgtaataacaattaaattaaattaaatatggaatatgaattgattctattaatgcaaaaattgtaaattgaatagtaattaaatattaagaaatgatattagattttatttaaattagaatgaagtgataggtgggataggtgggtgataaataaggaaaggggaaaagggaaaagggaaaattttttttcagttcagttcagttgagtcaaactttcaactttcaaattaaactatacacacaatttttgattttgaaaggagagagagatcaaccaccaccatcaccgccaatggagttttcagttagtgcgaacttttgtaccagtgtggtaagagagctaacacgattggaatgattactttgcaccaatgtctggccatatctagtaccactgctaccaactgctactaccaacctaacctctcccgactacacgacactacactactcacacgacacgacacgacacgacaaattttgtttaacttcttggtgtcgtgtaaaattataaaacttcctttttgtttttttttacaaccacaatcaatcaatcaactacaactacattaattcaacttatattaatggtcacctcccactttcctctttaaatgcaactggaagaattaattctgattgataaattagaagatcaaatcattgatcatcctgatgcttctactaaaaaagatttaaatgaatcactcgatgaaacatttcaaaaaaaattaaacgccagagctcaacaaattaaatcaaccaacaacaatagctacaataatacctccactagacaacaatctaaaggtcaacataggaattcaaatcaagattcttcttcttcttcttcttctacctcgtcaggtggtatcaattatcaatttcttattactaaatcacatttaaattacacatatactgattataattcattagaacaagaaatttgtgaatggttttcaataaatgattttaaatcacttggtgggttaaataatcttattctaaattatactaatgaccttaacaacaacaacaacaaagcaagtataactgaattgatacaaaatttacacgccaaccacaaaattgatgatctatctactaatacattacaaacaatattatattatagttttggtgaatatggtgataaaaaatctaaatcagatcaacttgatagtattaaacgaaataatttacaactcataaatgataaactatatcaaccattaattaatataattcaaaatttctttaatgatagaatatctcatgataaagctacaaccaatcacccagaatcatccacattatcaataagacaacaagaaccaatttattttattatacttacattaatgtattttatgattaatgttagtttatcaattgatcatgataacaatactattattagaagtgagtttaagaaatatttgaaagaaacagattttttaacttcattattaacatttattgaacattggaaatggcatcctaataattgttatcgtataagatatttaatattaatggttaataaactcatttttttagaattgggtgattcaaatcatatgaaacaatgtgatgaatttttagtcaaattacatcacgttaaaaataaaccaacaaaagaatcactggaatcaaatttaacttgttcaccattagattattttgttttccgacaagatttaattgataaatatccactttatgatgaaactgaattaaaaccttatgatttccgtaatttaaaaaagtcgttggataatgatgatgatactacaagtgacacatcaagtattcatagtcattctagtactattgaaggaaagtataaatattttatggcattacacaattcatccaattctctttctaatttaattgaaactcccaagactaataaatcacatactattttcggtcaattacctactcaaacagtacatttagctactccagtaccttcaccaactttggcagcatcagattatatgtctggtggagaaaaaattcgtaaatcatatcaagttaatcaagccatgcccatgatttatcctattactaacaattataacggtgatggcgttataccattagcaatgagagaagccgatgaaatattgagaaaatctatttatgaaagttattctattaaaagattatggaatgaacgagattattttatgaaacaagaacggggatatgccgatgggtatgataaaactaccaaaaatgatgatgatgatgatgatgatgataatgatgaatttgattataattttaatgaattgagacaaaaatatcctgaaaaaactctggtgattgatactttagaaagaattgaaactttatattcacaaaatttatgtcgattgaatactatagttgaagtttttattgaaaccattaaagtgaatcgattagattataatttaaattttgcagaattggaattaaattcaaaaaccaagtctggtcatcgtgatgaaacaattcaaaaaaaaattgaaatggtattaatactgcaattggaagttaataatgccaaagaattaacgttaaaagccacttcaagtttaattttaaatttattaaaatggtttaaaataagtcatatattgaaatcatattatttttcatcattattatttgatcaacaattttttgcaatttctttagaatatcttagtcgatgttttaataatgctaatttacaaagtatgattactactactaattctagacaaaaaaaggatgaattaactgaatatgaaatattaattaatcaaaataaattaatgaatcccaaaatatcattaccaaatgggaattttttcgataattgtttatgtttatcattaacccatcaagaagttaaatacaacgattttaattttattaataaaattttcatactgtcattacctgataaatttgattctaataatattaaacatgtttatatttcaaattttaatgataattttgctcatattttgagtgatatattaaatattactaacaaaatattaattaaaaatcaatcacaacgaatatttacatttaatgatttaaaaccttcagaattatataaaatgatattaattaattatgattgtcaatcatttaataaaccaatattgaaaactttgaaaaaattaataccttatcaaggtcgaaaatggaaatcttctaatatggatttaattagtcaaatttatttaaatttaaaattatcaatgaaagataattggttgagtggtaaagatttagaaagtgatttcaataattcttatgatcaagaaattgctcttagaggtttattacaattttataatatgagaaattatcctttacaaatgaataaaattggttatagaattaatcatgatataatgaatattcctcaattggatttaaatgatatgaatatatatgatgatgaatatgatgaagattattatgaggaagattattatgaagaagataatgatgatgataataataccaatactaatactaatactaatactaatgatactaacgataatagtattcaagatggtgaattcatttagttaacttagtgcgtgtgtataccaaaaattccattcaaagtagcccaaaaaaattttttcttctttctacaatttgtgggaatcaacttttcctccaactacaaattttttgatttgtttgtttgttgaatttataaaaagtatcatcattaataataattgtttctctttataagttatagaccatggttaaattaacacaaattgacgacgaaactcaacaacaatttgaaaatcaatcagttgctaaaaacaaccacattatcgatgaagctagttctgaagaagaatctgatgatgatgatgaatcagatcttgatgattttgattttgaaaatgaaactttattagaaagaattgttgctcttaaagatattgttccaccagaacaaagagaatccatatataatttatcatcaactataggagatttatttaaatcaagtgttcaaaatggtgggaaatttttatggacattgacttcaagttctttattattaggagttcctttagctttagcaattttatccgaaactcaattacaagaaatggaaagaggtatgtcattagaaaaatctgctcaagatgttttagctcctggatctgaagctgcatttggaaatgaaaataagaaataaatgaaatagaatagaataggatccaatccaatccaatccaatccaaaagcaaagtaaaagcaaattttcaaccttgtaaataaagatcttttttcaaaaaattcaaaaaaaaaataataataatatacatctaaagaatttatatttatattaatctaaagtaaaatggtaggattaaacaaaaaaaaaaaacacataatggtaagtaaacaagcaaacaagcaaacaagcaactaaacaagcaaacaactaaacaagcaagtaaccaaacaaaacgtatctctctctagtttatttttttatgcttaattgataatgcataaatatctaaataagtagtgatttcagtaatcacttcagcaacaaaaattccatgaatacctaaagttattccacaacctaaccaactaatggcatgtaacactttagcagtaccataaccataaatatcaattaaaattttactcaaaatcaattgaccaatagggacaaacattggatattgaataaatgggaattcttgtaaagttaaatgagccaaaataattcttccaacagaaaatgcaatagtacaaccaatagatatcactaatgggaaaccataatcataaagaatttgtggataaatcc

SEQ ID NO: 670 - protein, 150 aa, Candida albicans
MVKLTQIDDETQQQFENQSVAKNNHIIDEASSEEESDDDDESDLDDFDFENETLLERIVALKDIVPPEQRESIYNLSSTIGDLFKSSVQNGGKFLWTLTSSSLLLGVPLALAILSETQLQEMERGMSLEKSAQDVLAPGSEAAFGNENKK

SEQ ID NO: 671 - DNA, 4220 bp, Candida albicans
atccagtttacttaaatttaaatggacaattatcttaatagacaaacatcccagattattatcatctatcttcataaacttaaaggtgacaatgtccaaaattttattctttatctgatttgaaatttattaaacccaaaacattaaaatcatggttcacaaatggttcatctccccatggtaaattttgtgttgttgatgtacgagattctgattttgttggaggtcatataaaaggctgttatcattatcctgcagccaatttccactacacattgaatgaattatatcaaaaaatatatcagaataaaatacaagatattgttttccattgtgctttatctcaagtaagaggtccttcaagtacattaaaattcttgcgtggaattgatgatataaccgattccaaagtaaagagttatttcaatgatgacaatattcaagtatacgtgttacacgggggcttcacaaaatggcaagaagaatatgggaacgatagagaagtgacagaggcttatgaccaagaaatatgggagtttggatcctagtgatgtaatatgtgtatattgtgtttgattttcacatttctattgtacaattgtattagcaatatcgggttatattttagattgatatagatgtgtatataaatatgtataaatgcgccacgcaacatgtgtacatgcatgtactacttcagcaatcaaattaagcttggaccatcatgatagttatattgttgcacttgctgttgctgttgctgctgctgttgtggttgtggttggaatgcttggttgtatagcccagtttgggcattttgaaagtaaaattgtctttgagcttcttgttgggtctccgggaagactggaatagtaggtaaatgctccaatccaccagcagttgcttgtggtttcaattgttggtgttggttttgttgttgggtcagagcataattatcaaataactgcagggtagtttgtgatactttaaacggattattgccagttgcgttagcttgaatcttttgattttgttgttgttgctgctgttgtggttgaattgatccattatccaatgtgaatgctgtggtatgactggtagatgcgaatcttgtattagcaaatgggttagttgattgtgcttgtaaaggttgtggttgttgattcatgttcagttggctatatggttgagcaaactgttgttgtgaaacttgatgttgacctgttgccatacttgaaaatgggtttgtattagatctctgtaaccctactggctgttgtggttgttgtggttgctgtaattgcggagtaggttggatgaatgggtttgtatgctgtgcttgtaactgttgcggctgcgagccatatcctccaaacccaacaccagtaaatgtagattgcaatgtttgaccttgagaaatggatggcaattgtgaaaacaaagtctgttgctgctgctgctgtgtggcctgctgtgttgcctgctgttgtaaagcttgttgttgagcctgttgcaattgaacttgttgctgcaatgcttgctgttgcgcttgctgttgagcttgctgctgagcctgttgttgagcttggtcttgttgcagcggatccacaactccgacaattgggacaaacatggtattccacggattgtaggtctgttgcacgaccaatgaactgtgtctattcaaatcactactagtaccttgtaatttctgttgttgttctcttggttgttgttgttgttggcccggttcattcttactcttcttattaagtatagattgagtcggtttcagaacaatattgtctttcccctttttttctgctaaatattgttttcgattaatttcaaaatttggatcatccaaatattcttccaaagaacttgtcaaagctgtaggcgcgtgtttgatagttgggacgtgtaacttcgtagcatactccaaatgcttagctactctcaaataatcaatgacaaacttggtttgatctacaaattttttgtatatctttaaagatctttctgcatcaattttcgacatttcaaaataatgttccaagatgtttatcaccccttcattcaattcttggaaaagagccaacaaatcattgaccaataatctaaatgcagttaagacaatgtcattatttatctcgttttccatgaaattattcttcaataaagaatcaatttgtttctggacactttcaacttctctcaacaaacctttgtccacgtcaagtaatcttaatctaccaccttgctgattggtattgttatttgatctttcatctctaacataatccacccccgtcgactcaaattgcttgactctggtgtgtaaatacttggcatatctcgtgataaatttgatatcagaattgaaactgttgctatttttgatgatgttattattgttcaaatttaaaagatttggcgatgcttgattacttaaataatctaacgtcacatttttatccccttccctaatcatcaaatgaatcacaatcaaggctttataaacgacagaccaggaactgtcgtgcaatcgtgcctgtaatgttctcattatagtgttgaagttctccttagaaataagggaatgattcaacgatgtagccattaatatgggctcaatatattttggtttaggggcagccaccttcactttagtagcacccttgacaatcttctcataggtagtcattgtctagtgttgttgaagtagaaatatttgaaaacaaataatgttactcggcagctactgaagtgtaataaaaaaaaagaccccaaaaataattgaaaatgtggtacagataattctattggtaatggttgcctgctaggtaatgatccttgcaaagagttctgctatttcttcaatgaattaacacaactaacagaattggaaaattgtacaagttgtggaaaatatttaataatagtaatgtgtgtttgaaaattagtataattttactcatgggcagtgcgcacaaacaaataaaacctcaactcaatagttgtcgtcggctgtttctccttgcttttttatgatctttgtttttctttttttgttccatgtaacgttgccggaggctgtacaatttataactgcccttgttaatagtagctatacttgaattggctaaaataatgactcgttttaagtcaattgacactatacatttcagaatatttaatgataaacataagcaagtattatgatcatcgactatggggtgtattctcattcgtgtgaaaaccaatctcggaaaacagattagattatcatagacaccatttttgaaattgtcttttttctatgagcagtattaatagcatatatgtaatttgtttacactgccattgctaaataatatcaagtacatatacttgcttattattgaacattaggcacataatgtagatatatatttatcgtcgattctaaaataaaactcaagacacactattcactctgaaacggactttatgtctgttttggtctctacaaaacgcatctataattcaccggcccattcatgtggcattgctcgatagacgtaaacttcaccttttgtcaagttcttcaaatttatctcaccatcaacaacatatcgtttaccaccaacattttgttctaaaaccatcaatttatctcccagtttaccaatcacaactgacgtatgatctggggcacctgcagattgtgtgacaccagtacttgcatcataaaacgtacaagcgttgaactgtaaaatgtcacctcttcttacctcatcgagttgctgtgaattgttgataaaatagactccattaccagcattcccaatttgtaatattggataaccatggatggtataacatgatacgaatgcatgatttccgcatcccttttgtaatgcttcttttgccaaatcccaacactcacctcgtccaacagtcttacctctgtgatgttcacaccaagatgctatatactccccgaatctttgatggttagcaatgagttcttgtttgaaaggaattgtatcgattggagatggaacatatttctcaataaccacatttacgttactaatgtcattattactgtattcaaatttatatgtgactatggataagtctttaagtctcacagttaaagttgtagtacccttcccataagagcctgatgatgtcgtgtacgaaaacttgtgattgattccatgaaatacttt

SEQ ID NO: 672 - protein, 609 aa, Candida albicans
MTTYEKIVKGATKVKVAAPKPKYIEPILMATSLNHSLISKENFNTIMRTLQARLHDSSWSVVYKALIVIHLMIREGDKNVTLDYLSNQASPNLLNLNNNNIIKNSNSFNSDIKFITRYAKYLHTRVKQFESTGVDYVRDERSNNNTNQQGGRLRLLDVDKGLLREVESVQKQIDSLLKNNFMENEINNDIVLTAFRLLVNDLLALFQELNEGVINILEHYFEMSKIDAERSLKIYKKFVDQTKFVIDYLRVAKHLEYATKLHVPTIKHAPTALTSSLEEYLDDPNFEINRKQYLAEKKGKDNIVLKPTQSILNKKSKNEPGQQQQQPREQQQKLQGTSSDLNRHSSLVVQQTYNPWNTMFVPIVGVVDPLQQDQAQQQAQQQAQQQAQQQALQQQVQLQQAQQQALQQQATQQATQQQQQQTLFSQLPSISQGQTLQSTFTGVGFGGYGSQPQQLQAQHTNPFIQPTPQLQQPQQPQQPVGLQRSNTNPFSSMATGQHQVSQQQFAQPYSQLNMNQQPQPLQAQSTNPFANTRFASTSHTTAFTLDNGSIQPQQQQQQQNQKIQANATGNNPFKVSQTTLQLFDNYALTQQQNQHQQLKPQATAGGLEH

SEQ ID NO: 673 - DNA, 1700 bp, Candida albicans; identical to SEQ ID NO: 479

SEQ ID NO: 674 - protein, 548 aa, Candida albicans; identical to SEQ ID NO: 480

SEQ ID NO: 675 - DNA, 330 bp, Homo sapiens
atggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataa

SEQ ID NO: 676 - protein, 109 aa, Homo sapiens
MAGALVRKAADYVRSKDFRDYLMSTHFWGPVANWGLPIAAINDMKKSPEIISGRMTFALCCYSLTFMRFAYKVQPRNWLLFACHATNEVAQLIQGGRLIKHEMTKTASA

SEQ ID NO: 677 - DNA, 384 bp, Homo sapiens
atgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataa

SEQ ID NO: 678 - protein, 127 aa, Homo sapiens [sequence omitted]

SEQ ID NO: 679 - DNA, 399 bp, Homo sapiens
atggcggccgcgacgttgacttcgaaattgtactccctgctgttccgcagacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataa

SEQ ID NO: 680 - protein, 132 aa, Homo sapiens
MAAATLTSKLYSLLFRRPPPSPSPSSWASCSSSAPSIKARTLSTTTSTRGSCGNTSSTSMRTSSSLEAPIQARRTRSTQQLFAQSWSLSLKMMLKVLFMDHHSLLARNGFTYKTDSLPSAVFEVCLVSMLRK

SEQ ID NO: 681 - DNA, 312 bp, Homo sapiens
atgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttga

SEQ ID NO: 682 - protein, 103 aa, Homo sapiens [sequence omitted]

SEQ ID NO: 683 - DNA, 318 bp, Homo sapiens
atggtgaagcagatcgagagcaagactgcttttcaggaagccttggacgctgcaggtgataaacttgtagtagttgacttctcagccacgtggtgtgggccttgcaaaatgatcaaccctttctttcattccctctctgaaaagtattccaacgtgatattccttgaagtagatgtggatgactgtcaggatgttgcttcagagtgtgaagtcaaatgcacgccaacattccagttttttaagaagggacaaaaggtgggtgaattttctggagccaataaggaaaagcttgaagccaccattaatgaattagtctaa

SEQ ID NO: 684 - protein, 105 aa, Homo sapiens
MVKQIESKTAFQEALDAAGDKLVVVDFSATWCGPCKMINPFFHSLSEKYSNVIFLEVDVDDCQDVASECEVKCTPTFQFFKKGQKVGEFSGANKEKLEATINELV

SEQ ID NO: 685 - DNA, 594 bp, Homo sapiens
ccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatactgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaa

SEQ ID NO: 686 - protein, 197 aa, Homo sapiens
PSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYILKCGFLLWCMAPSPSNGAELLYKRIIRPFFLKHESQMDSVVKDLKDKAKETADAITKEAKKATVNLLGEEKKST

SEQ ID NO: 687 - DNA, 1653 bp, Candida albicans; identical to SEQ ID NO: 475

SEQ ID NO: 688 - protein, 550 aa, Candida albicans; identical to SEQ ID NO: 476

SEQ ID NO: 689 - DNA, 20 bp, Artificial Sequence
  Description of Artificial Sequence: Synthetic oligonucleotide
atggacgggtccgggagcag

SEQ ID NO: 690 - DNA, 27 bp, Artificial Sequence
  Description of Artificial Sequence: Synthetic oligonucleotide
tcagcccatcttcttccagatggtgag

SEQ ID NO: 691 - DNA, 1685 bp, Saccharomyces cerevisiae
aaaaaaccactccgaaggttcgaggatgacaaatcgccccttagctgtggccatacaagcttggcaccgacgaaaaagggaaaaaggaaaagaatgtcgtacaagaactcttacaaccacgttgagatttcatttaacaacgcccccctttccattatataagaaggcattaatttttatgtaataaaaaaagaatttctcgaaaatgtcttacaattaattttttcttttgtagagtagggctttaatagactgatatatacggtattataagtgaacgaaaaaaacagcaatgggtttatttgataaagtgaagcaatttgctaacagcaataataacaacaatgattctggcaataacaatcaaggcgattatgttaccaaagctgagaatatgatcggcgaagatagagtcaatcaattcaaaagcaaaatcggagaggacagatttgataagatggagtccaaggttcgtcaacaattttctaatacctctataaatgacaacgactccaacaacaacgactcatatggttctaataacaacgattcatatggttctaacaacaatgattcatatggctctaacaacaatgattcatatggctccaacaacaatgattcatatggctctaacaacgatgattcctacggttcttccaacaagaagaagagctcttatggttctaacaatgacgattcgtacggctccagcaacaacaatgactcttacggttccaacaacaatgactcttacggttccaacaacaatgactcttacggttccaacaatgacgactcttacggttcgtcaaacaagaataagagctcttacggttccaacaatgacgattcttatggctctaacaatgatgattcatatggttcttccaacaagaagaagagttcttatggttccagcaacaacgattcgtatggttctaacaacgatgattcatatggttctaacaacaatgattcatatggctctaacaacgatgattcctacggttcttccaacaagaagaagagctcttatggttctaacaatgacgattcgtacggctccagcaacaacaatgactcttacggttccaacaatgacgactcttacggttcgtcaaacaagaataagagctcttacggttcttctagcaacgatgattcttacggatcttccaataacgacgactcttacggttcttccaacaagaagaagagttcttatggttccaacaatgacgattcttatggctctaacaatgatgattcatatggttcttccaacaagaagaagagttcttatggttccagcaacaacgattcgtatggttctaacaacgatgattcctacggttcttctaacaaaaagaagagttcttatggttccaacaacgatgattcatacggctccagcaacaacaatgactcttacggttccaacaatgacgactcttacggttcctctaatagaaacaagaactcctatgggtcttccaactacggttcatccaacaatgatgactcttatggttcatctaatagaggcggtcgtaatcaatacggtggtgacgacgattactaagtttttggatgtcttcgataaaaaaaatatattattgtgtttagacttaagtatgaaaattttatgtatgagctgtggctatgtatccgctggcaaatag

SEQ ID NO: 692 - protein, 394 aa, Saccharomyces cerevisiae
MTTTPTTTTHMVLITTIHMVLTTMIHMALTTMIHMAPTTMIHMALTTMIPTVLPTRRRALMVLTMTIRTAPATTMTLTVPTTMTLTVPTTMTLTVPTMTTLTVRQTRIRALTVPTMTILMALTMMIHMVLPTRRRVLMVPATTIRMVLTTMIHMVLTTMIHMALTTMIPTVLPTRRRALMVLTMTIRTAPATTMTLTVPTMTTLTVRQTRIRALTVLLATMILTDLPITTTLTVLPTRRRVLMVPTMTILMALTMMIHMVLPTRRRVLMVPATTIRMVLTTMIPTVLLTKRRVLMVPTTMIHTAPATTMTLTVPTMTTLTVPLIETRTPMGLPTTVHPTMMTLMVHLIEAVVINTVVTTITKFLDVFDKKNILLCLDLSMKILCMSCGYVSAGK

SEQ ID NO: 693 - DNA, 2138 bp, Saccharomyces cerevisiae
cccgggtgatgcagttgcggccggccctggccaatcagatccctttaaaaatgggcccggtgcgcttctaccccttcacgccttttacgcctttttcgaatcttgtatttattgtaattattaaacattggtcatatcaaattcacatcagacttcaatttttcaattcactttctgaataagagcccttcccttcatacaagtagagatattatactgtcatagctctttcaattggtcttattagattgtctccatctttcccattgacgttgttactccctctcttttttcgtttttaactgatttctcatatattcccaaacaggcatatatactcgacgtcaagaaagaaaagaaaagaaaaccctcataaaaaatataatcgagaagtttttttcctcatcgcgaaccattagtataacagattgatcgttcagctctcataactatcgcaagaacagtaacaaaataaataaaaaaaacacgcacatataataatgttggctcgtactgctgctattcgttctctatcgagaactctaattaactctaccaaggccgcaagacctgccgctgctgctttggcttccaccagaagattggcttccaccaaggcacaacccacagaagtttcctccatcttagaggaaagaattaagggtgtgtccgacgaggccaatttgaacgaaactggtagagttcttgcagtcggtgatggtattgctcgtgtttttggtttgaacaacattcaggctgaagaattggtcgagttctcctctggtgttaaaggtatggctttgaacttggagcctggtcaagtcggtatcgttcttttcggttccgatagactggttaaagaaggtgaattggtcaagagaaccggtaatattgttgatgtcccagtcggtccaggccttttgggtagagttgtcgacgctttaggtaaccctattgatggtaaaggtcctattgacgctgccggtcgttcaagagctcaagtcaaagcaccaggtattttgccaagaagatctgtccatgaaccagttcaaaccggtttgaaagccgttgacgccttggtccctatcggtagaggtcaaagagagttgattattggtgatcgtcaaacaggtaagactgctgtcgccttagacaccatcttgaatcaaaagagatggaataacggtagtgacgaatccaagaaactttactgtgtttacgttgccgttggacaaaaaagatctaccgttgctcaattggtccaaactttggaacaacatgacgccatgaagtactctattattgttgcagctactgcatctgaagccgctcctctacaatacttggctccatttactgccgcatccattggtgaatggttcagagataatggaaagcacgctttgatcgtctatgacgatttgtccaagcaagccgtggcataccgtcaattatctttgttgttgagacgtcctcctggtcgtgaagcctaccctggtgatgtcttttacttgcatccaagattgctagaaagagccgctaagctttctgaaaaggaaggttctggttctttaactgctttgcctgttattgaaacccaaggtggtgatgtctccgcttatattccaaccaatgttatttccattaccgatggtcaaatattcttggaagctgaattattctacaagggtatcagacctgccattaacgttggtttgtccgtttctcgtgtcggttccgctgctcaagttaaggctttgaagcaagtcgctggttccttgaaattgtttttggctcaatacagagaagtcgctgcttttgctcaattcggttccgatttagatgcctccaccaagcaaactttggttagaggtgaaagattgactcaattgttgaagcaaaaccaatattctcctttggctacagaagaacaggttccattgatttatgccggtgttaatggtcatttggatggtattgaactatcaagaattggtgaatttgagtcctcctttttgtcctatctaaaatccaatcacaatgagcttttgaccgaaattagagaaaagggtgaattgtctaaagaattgttggcatctctaaagagtgctactgaatcatttgttgccactttttaa

SEQ ID NO: 694 - protein, 545 aa, Saccharomyces cerevisiae
MLARTAAIRSLSRTLINSTKAARPAAAALASTRRLASTKAQPTEVSSILEERIKGVSDEANLNETGRVLAVGDGIARVFGLNNIQAEELVEFSSGVKGMALNLEPGQVGIVLFGSDRLVKEGELVKRTGNIVDVPVGPGLLGRVVDALGNPIDGKGPIDAAGRSRAQVKAPGILPRRSVHEPVQTGLKAVDALVPIGRGQRELIIGDRQTGKTAVALDTILNQKRWNNGSDESKKLYCVYVAVGQKRSTVAQLVQTLEQHDAMKYSIIVAATASEAAPLQYLAPFTAASIGEWFRDNGKHALIVYDDLSKQAVAYRQLSLLLRRPPGREAYPGDVFYLHPRLLERAAKLSEKEGSGSLTALPVIETQGGDVSAYIPTNVISITDGQIFLEAELFYKGIRPAINVGLSVSRVGSAAQVKALKQVAGSLKLFLAQYREVAAFAQFGSDLDASTKQTLVRGERLTQLLKQNQYSPLATEEQVPLIYAGVNGHLDGIELSRIGEFESSFLSYLKSNHNELLTEIREKGELSKELLASLKSATESFVATF

SEQ ID NO: 695 - DNA, 884 bp, Saccharomyces cerevisiae
taaaagccttgcatattgctcagagtaaattacaagcgttaaatgataattcaaaatctcaaaatacaaatgacagttcttccaataattttacgaatgctgcaacttattcaaagcctaaattgaatatcaagattttaaacgcagaattccaatttgatagaaaggaattaacgttttactacgtttgtgaggagagaaatgattttagagacttgataaaagagctgttcaaatattacaagacaagaatttggttgtgtgccatcccgaataatctgtctattgattctaagtattatgataaacaacaaaaagagctgaaattatatcaaaacatagtaaaaaattacaatgctgaagatttaatgaatgtcaatgagttttcgcagaacagggggaataacagagttaattttgcacctccgttgaacgaaattgaactcgacaactttcagattgctgtgtatgaagaattagttcacgaattatttcattaaatgatctgttatttccttgttgtaactataaattttctaaaagaaaagacaaccatttgccattattttgttaacattttttcattgtttttgtttttgtttgtttttgtttttgtttttatttttgtctactttttttatgttattttgttttatcgtttctgttcgttgtttacctattttcctgccaattcaatttggtactatctttctattatcaatattttctttcccttatgtttttttctatatgaaaacttcacagggagaaatagaagaaaatgttcattattctgtttaactttgataaaaattacttatacgtctcccaatcatggtttcatggtcactggtaaggaaaaattcgaaaaactacgggactaa

SEQ ID NO: 696 - protein, 127 aa, Saccharomyces cerevisiae
MICYFLVVTINFLKEKTTICHYFVNIFSLFLFLFVFVFVFIFVYFFYVILFYRFCSLFTYFPANSIWYYLSIINIFFPLCFFLYENFTGRNRRKCSLFCLTLIKITYTSPNHGFMVTGKEKFEKLRD

SEQ ID NO: 697 - DNA, 3416 bp, Saccharomyces cerevisiae
tatctaccggctgcaagcagccggtcggtggcaaatccggcgcttccccctcaaaaaaaaaaaaaaaaaaaaaaaaagggaactctcagaacgggggaggttgaagagcaggccaagggaaatattagttttgacctatgtgggaaacagaattttcaatgagttatggcaacttggccgagtggttaaggcgaaagattagaaatcttttgggctttgcccgcgcaggttcgagtcctgcagttgtcgttatttttctcttttttttcaatttcccttgttcgtcagatcgaggcggtagaagaaacaattacttttcctaaatgggtaaaaactcgtgttttaggaaaaaaaagaaaaatttggtcaaaactcgaaagataggttcttaatcttctttcaagttgaaaaggcctacgctcttttccttgaagcattttcatcctactgctcgtattgaactccactataagcgcaccaaaaagatacaaacgtcaattatggaaggctcaacgggatttgatggagacgctactacttttttcgctccagacgctgtgtttggtgacagagtgcgcagatttcaagagtttttagatactttcacctcatacagagactctgtaaggtccatacaagtttacaacagcaataacgcggccaactacaacgatgatcaagatgacgcagacgaacgagatttgctaggtgatgacgacggtgatgatcttgaaaaggaaaagaaagcagcatcgtccacctcattgaatatactccctcacaggattatcatctcgcttgatgacttgagagaattcgacaggtcgttctggtcgggcattttagtcgaaccagcatacttcatcccgcctgccgaaaaggcgcttactgacctagcagattccatggacgatgttccacatcccaatgcctctgcagtatcgtctcgccatccttggaagctttcgttcaaaggctcatttggtgcacacgcattgtctcctcgtactctaacggcacaacatttaaacaaactggtctctgttgagggtatcgtaactaagacttcgttggtcaggccaaagcttatcagatctgtccactacgcggcaaagactggtagattccattacagagattatacagatgctactacaactctcaccacccgcatcccaacgcctgccatctatccaacggaggacactgaaggtaacaaactaaccaccgaatatgggtatagtacgttcatagaccatcagcgtatcactgtgcaagaaatgcccgaaatggcccccgctggccaacttcccaggtccattgacgtcattctcgatgacgaccttgtggacaagaccaagccaggtgacagagttaacgttgtcggggtattcaagtcgcttggtgctggtggcatgaaccagtccaactctaatacattgatcgggttcaaaactctgatcctaggtaatacggtgtatcctctccacgccagatccacgggtgtcgctgcgagacaaatgttgacagatttcgatataagaaatatcaataaactatccaaaaaaaaggacattttcgatatcttgtctcaatctttagcgccttctatttatggacatgaccatataaagaaagccattttattgatgctcatgggaggtgtggagaaaaatttagaaaatggctcgcatttaagaggtgacatcaatatcctaatggtgggtgatccatccactgccaagtcccaattgctaaggtttgtgttgaatacagcatcactggcaattgctactactggtagaggttcttccggtgtcggtttgaccgcagcggtcactactgatagggaaacaggtgaaagaagactagaggctggtgccatggttcttgctgaccgcggggttgtatgtattgatgaatttgataagatgacagatgtggatagagtcgccattcatgaagtaatggaacaacaaacggtgacgattgccaaagcaggtattcacacaacattaaatgctcgttgtagtgttattgctgccgcaaatcccgtttttgggcagtacgatgtcaatagagatccacaccaaaacattgccctaccggactcgctgttgtctcgttttgatttactatttgttgtgacagacgatatcaatgaaatcagagatagatccattagtgagcatgtcttaagaacacacagatatttgcctccaggttatttagagggtgaacctgtgagagagcgtttgaatttatcattagccgttggggaggatgcagatataaatcctgaagagcattccaactccggggctggtgtagaaaatgaaggagaagatgatgaagaccatgtcttcgaaaagttcaaccccttattacaagcaggtgctaagttagcaaaaaacaaaggtaactataacggtacagaaattccaaagctagtcaccatcccattcttaagaaagtacgttcaatatgccaaggaaagggttattccacagttaacacaagaagccatcaatgttattgtgaaaaattatactgatttaagaaacgatgataataccaaaaaatcgcccattactgcaagaactttggagactttgatcagattagccacagctcacgccaaagtcaggttatccaaaacagtcaacaaggtggatgctaaagtggctgccaatctactaaggtttgcactattgggtgaggatatcggcaatgatatcgatgaagaggaaagtgaatacgaagaagctttgtcgaagaggtctccacagaaatcaccgaaaaaaagacaaagagtcagacaaccagcaagcaactctggatccccaatcaaatctactccaagaaggtcaacggcatcttccgttaatgccacgccatcgtcagcacgcagaatattacgttttcaagatgacgaacagaacgctggtgaagacgataacgatataatgtcaccgcttcctgcggatgaggaagctgaattacaaagaaggcttcaactggggttgagagtgtctccaagacgtagagaacatcttcacgcacctgaggaaggttcgtcgggacctcttaccgaggtcggtactccaagattacctaacgtatcttctgcaggtcaggatgatgagcaacaacagtcagttatttcttttgacaatgtggagcctggtaccatttctactggtagattgtctttaatctcaggtattattgcgcgtctgatgcaaacagaaatatttgaagaagaatcctatcctgtggcctctttgttcgaaagaatcaacgaagaactaccggaggaggaaaaattctccgctcaagaatatttagcaggtttgaagatcatgtcggacagaaataacttaatggttgctgacgataaagtttggagagtctga

SEQ ID NO: 698 - protein, 971 aa, Saccharomyces cerevisiae
MEGSTGFDGDATTFFAPDAVFGDRVRRFQEFLDTFTSYRDSVRSIQVYNSNNAANYNDDQDDADERDLLGDDDGDDLEKEKKAASSTSLNILPHRIIISLDDLREFDRSFWSGILVEPAYFIPPAEKALTDLADSMDDVPHPNASAVSSRHPWKLSFKGSFGAHALSPRTLTAQHLNKLVSVEGIVTKTSLVRPKLIRSVHYAAKTGRFHYRDYTDATTTLTTRIPTPAIYPTEDTEGNKLTTEYGYSTFIDHQRITVQEMPEMAPAGQLPRSIDVILDDDLVDKTKPGDRVNVVGVFKSLGAGGMNQSNSNTLIGFKTLILGNTVYPLHARSTGVAARQMLTDFDIRNINKLSKKKDIFDILSQSLAPSIYGHDHIKKAILLMLMGGVEKNLENGSHLRGDINILMVGDPSTAKSQLLRFVLNTASLAIATTGRGSSGVGLTAAVTTDRETGERRLEAGAMVLADRGVVCIDEFDKMTDVDRVAIHEVMEQQTVTIAKAGIHTTLNARCSVIAAANPVFGQYDVNRDPHQNIALPDSLLSRFDLLFVVTDDINEIRDRSISEHVLRTHRYLPPGYLEGEPVRERLNLSLAVGEDADINPEEHSNSGAGVENEGEDDEDHVFEKFNPLLQAGAKLAKNKGNYNGTEIPKLVTIPFLRKYVQYAKERVIPQLTQEAINVIVKNYTDLRNDDNTKKSPITARTLETLIRLATAHAKVRLSKTVNKVDAKVAANLLRFALLGEDIGNDIDEEESEYEEALSKRSPQKSPKKRQRVRQPASNSGSPIKSTPRRSTASSVNATPSSARRILRFQDDEQNAGEDDNDIMSPLPADEEAELQRRLQLGLRVSPRRREHLHAPEEGSSGPLTEVGTPRLPNVSSAGQDDEQQQSVISFDNVEPGTISTGRLSLISGIIARLMQTEIFEEESYPVASLFERINEELPEEEKFSAQEYLAGLKIMSDRNNLMVADDKVWRV

SEQ ID NO: 699 - DNA, 1136 bp, Saccharomyces cerevisiae
ctttcagttgggcatctttttttttcacaattaggccgcccttttttcccaaattggcacttgtttgtacgatctttagctagaacttggagacctgaaacgtggtgattcttatatttaaaggaataccgatcttttccgtttcaacaccccaattgtgagaattttatttcttgcatttcggaaaatttagatacattcacatccatacttggacacatatatatatacaatataatcattgacacaggccatcgccattgagtaaactgtctttgaactgtctaaagaacttagaactatagtgttgtcccaagaagttaaaaattgaacacttgtgagaattataaaacagagtaagcaaagaaagaatagagaaacaatactccgctaccgattctcctttttttccttataaaaaaagctcgagaataattactttattcttatccctccactcctttcaggtattctttaccgatttgcatatcaatcatataatgagcaccgcattcaacgattactgcactgtttgtgatcgtctcattccaacatctccacagaaaacgaacattaataccaggaagatccaaagggacaatgaaaccaagagcagtttacaatcaaataagttatattgctccgaagattgtaagctgaaggattcgaaccctcttaatgagaaattattatcccacttgcataaaaaatcaaaaacttctcattcgcataatctcactccaccgctttcatattctaaaaatttaactgcatcaaacctcttcgagccgactacctcactatcttcatctccgacatcttcaactatcccctttgacgagttggagaagctagagtccttattaatttcaccattgctgctacctcaggatggtatagtcaatcctaagcaggagtctaatccttctcgtgttgacgaatatgatgaaaatgaacattatttgaacttagccgactctcttagactcgattctagttaccaattgcattcaaaggcacatttgggttacgaaaacaacttgccacgatcaaacgatctaattgatgatcatttgatctcagatcagatcattgagaataactacaacctatggtttagactatcctccagttaa

SEQ ID NO: 700 - protein, 211 aa, Saccharomyces cerevisiae
MSTAFNDYCTVCDRLIPTSPQKTNINTRKIQRDNETKSSLQSNKLYCSEDCKLKDSNPLNEKLLSHLHKKSKTSHSHNLTPPLSYSKNLTASNLFEPTTSLSSSPTSSTIPFDELEKLESLLISPLLLPQDGIVNPKQESNPSRVDEYDENEHYLNLADSLRLDSSYQLHSKAHLGYENNLPRSNDLIDDHLISDQIIENNYNLWFRLSSS

SEQ ID NO: 701 - DNA, 2117 bp, Saccharomyces cerevisiae
agagtataacgagtacattaatgagaaagattcaagtagagcgcagcgtcaaaacgctgccgccgttttaagcaagctcgcccatgacttttgggagaacgactgtgtcattgacgaagacatattcgaagattcgtctgacgaagaacaatcatgattgcatctcttaatcgttacacatacataccttctacctctgtactgttacatatgcattgactttacgatctaatataaatccttttgatgttaccccgcctgtgggctcgttctcctttcgtttcttacgattttttcgccggaacaagaaaaaacagaacaaaacaaatcagcgatcgtatacatgggtctttgatttctgcttgcttcttacaaacaacaaacgcaaaccgttcattgagtgctctgtgactggttttcatgtggatgccatagtagagaaaagacacatacaaaaatttcgcgcattcgctggcccttttcctgctctcctcttccccatgtccatgcccatagcaagtaccactctagcagttaacaacctcaccaatataaacggaaacgcaaattttaacgtacaagcaaacaaacaactccaccaccaggctgtcgactcgcccgcaagatcttcgatgaccgccacgaccgccgccaactccaacagcaactcttccagagatgactctactattgtcggcctacattacaagatcggcaaaaaaataggggaaggttcctttggtgtgctatttgaaggtactaatatgatcaatggcgtacccgtcgcgatcaaattcgagcccagaaaaacggaggcccctcaattaagagatgaatataaaacatataaaattctgaatggcactcccaatatcccctacgcgtactacttcggccaagaaggtttgcacaatatcttggtcattgatcttttgggtccctctttggaagatttatttgattggtgtggaagaaaattttctgtcaaaacggttgtgcaagttgctgtccaaatgattactttgattgaagacttgcacgcacatgacttgatataccgtgatatcaaaccagacaatttcttgattggaaggcccggccaacctgacgcaaacaacatccatttgatcgacttcggtatggccaaacagtatcgtgatccgaaaactaaacagcacatcccatatagagagaaaaaatcactcagcggcactgccagatatatgtccattaatactcaccttggaagagagcagtccagaagagatgatatggaggccttgggtcacgttttcttttatttcttgagaggccacttaccctggcagggtttaaaagctccaaacaataagcaaaaatacgaaaagattggtgaaaagaaaagatctactaacgtttacgatctagctcaaggcttacctgtgcaatttggcaggtatctagaaatcgtcagaagtctttcctttgaagagtgtcccgattatgaaggctatagaaaactattactatctgtactggatgatttaggtgaaaccgcggacggccaatatgattggatgaaactgaacgatggccgtggttgggatcttaacataaacaagaagccaaatctccacggatacggccatccaaatccaccaaacgaaaaatcgagaaaacatagaaacaaacagctccaaatgcaacagctccaaatgcaacagctccaacaacagcaacagcaacagcaatatgctcaaaaaactgaggcagatatgcgcaattctcaatataaaccaaagttagaccctacttcttatgaagcttaccagcatcaaacccagcagaaatacctgcaagaacaacaaaagagacagcagcaacaaaaacttcaggagcaacaacttcaagagcaacaattgcaacagcagcaacagcaacagcaacagctacgtgcaacaggccaacctccatctcagcctcaagcgcaaactcaatctcagcagtttggcgctcgttatcaaccacaacaacaaccttctgctgctttaagaactcctgaacagcacccaaatgacgataattcaagtctagctgcttctcataagggctttttccaaaaattaggttgttgctaa

SEQ ID NO: 702 - protein, 538 aa, Saccharomyces cerevisiae
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGQPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINKKPNLHGYGHPNPPNEKSRKHRNKQLQMQQLQMQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 703 - DNA, 1835 bp, Saccharomyces cerevisiae
tagagcagattgttttgagtaggatttaggaatcaagacctccatctttgtcgcattattcctaaatgtaacgtaactcgtttgataagagaatgtctaatcgaagagagttaataacttaataagctctttaaaagaacgatggcatttatcgtctcctatgccaagataattactggctcaaaattgttcagcgttcataaaactttgatatcactttctggcgcacaagctaacctttatgtagttcttacgtagattctttttagcaagtgcctggtagtggttattacataaatgtatcttttcatttgataacaatttcttcagtagcatgtcgtgtctagcacgtgacgtagaactgtggcttttttgttgtcattatgacaatcaagataccaaaattcagtcatgtttaaaaggggaaggtacgatagagatatatataaagtgttcaatttactataattgcgtatagaatccattgttacttgctctcaatgaaacaacgattcattcgtcaatttacgaacctaatgtctacttcgagaccgaaagttgttgccaacaaatatttcacttctaacactgccaaagatgtttggtcgctaaccaatgaagccgctgcaaaagctgccaataactccaaaaaccaaggccgtgaacttattaatttaggccaaggctttttttcatattcccctcctcaattcgccattaaggaggctcagaaagccctagacattccaatggtcaatcaatattctccaactagaggtcgaccttcattaattaattccttgattaagttgtattctcctatttataacacagaattgaaagcggaaaatgttaccgtaacaacaggtgccaatgaaggtatactttcttgcttgatggggcttttgaacgctggcgacgaggttattgtttttgaacctttctttgaccaatatattccaaatatcgaactttgcggtggtaaagttgtttacgtccccataaatcctccaaaggaattggatcaaaggaatactagaggtgaagaatggaccattgactttgagcagttcgaaaaagcgattacatccaagacaaaagctgtcattatcaatacccctcacaacccaattggtaaagttttcacgcgcgaggaattaaccactttaggtaacatttgcgtcaagcacaacgttgtgattatatctgatgaagtctatgaacacctttacttcactgattctttcactagaattgccacactctctccagaaattgggcaactaaccttaacggtcggttctgccggtaaatcgtttgctgctactggttggagaattggttgggtcttatccttgaacgcagagttgttaagttatgcagctaaggcacatacaagaatttgttttgcatctccatcccctctacaggaagcttgtgcaaactctattaacgacgctttaaaaattgggtattttgaaaaaatgagacaggaatatatcaacaaattcaaaattttcacatcgatctttgatgaattgggactaccatatacagctccagagggtacatattttgtcctcgttgatttctctaaagtgaaaattcccgaggactatccctacccagaggagatcctgaataagggaaaagattttcgcatttctcactggttgatcaatgaattaggtgtggttgccattccaccaactgaattctatatcaaagagcacgaaaaggctgctgagaatttgttaaggtttgcagtttgtaaagatgatgcttatctagaaaatgccgtagagagattaaaactactcaaggactacttataa

SEQ ID NO: 704 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 705 - DNA, 881 bp, Saccharomyces cerevisiae
aaaattaatggatgtaacacaaaatattggcattgatcttttcattggaattggcgcgtttaatgccgcatatacaagaacatatacgagggatggtctattggaagacccggataatgttagcttccgtgaagctctctctgaaggcaaagatattgaagtcgccaaagatcttcaaagagttcacgatccacatgatgaaagtgatgaaatgacgtcagatgaggttgaattacatgttaatttgggccaagttgggttcgtctttatagaagccaatgtgaaaaaatatgcgtttgggagtgtttatggccaaattggaattcctcctgcgtataatggaaccgagatcaagaaggatactattttacagaaaggagaagaattgccaccaagatatgctgacactgataatttctttggtagtatgaaggtaaaagaagggtcatcctctaggataacggcgcaaactagtaagcccctgtggtctgttgggacgtatgaaagaatctcttctaactttgacagagaaaataatgtttaccacgacagtcttgaaaccgacgataacaacaccgataacaatgttaataacaacgatgagaacgctggttgcaatgaaaattcgccattattggaagatgatggcaataaaagaccggaaaattcaaataccccccgtgaagtatcagatggagctatcaataagaaccctagaaataaatctactaaaaaacgtcaaagaaacagaggcaaatcttctaaaaagaagaacagatcgagaaaataagagacattatgaatttggttttttttacaatttacgcatacacaatatatacattcctactagcttttttttcttcaattcgatagtttag

SEQ ID NO: 706 - protein, 126 aa, Saccharomyces cerevisiae
MKESLLTLTEKIMFTTTVLKPTITTPITMLITTMRTLVAMKIRHYWKMMAIKDRKIQIPPVKYQMELSIRTLEINLLKNVKETEANLLKRRTDRENKRHYEFGFFYNLRIHNIYIPTSFFFFNSIV

SEQ ID NO: 707 - DNA, 1091 bp, Saccharomyces cerevisiae
ggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcataatccctgacgaggaagaacccaccgccacaggtgcgcaacctcatctctacattcctgatgaagactaattgcaatgcgatgtggccacgttatataatgcgtttaaggtgtacgaaaacccatgctgttctggcccgtcgggttttctgacaaattgtcctttagggatttttcggtttggctcgggttggcaaagtcggctggcaacaaaccaggacatatataaagggaggtaattcgtcagatcaatgccgaaccgttctcaacgggccttcccctcgttcaattgctcacaaccaaccacaactacatacacatacatacacaatggtcgctcaagttcaaaagcaagctccaacttttaagaaaactgccgtcgtcgacggtgtctttgacgaagtctccttggacaaatacaagggtaagtacgttgtcctagcctttattccattggccttcactttcgtctgtccaaccgaaatcattgctttctcagaagctgctaagaaattcgaagaacaaggcgctcaagttcttttcgcctccactgactccgaatactcccttttggcatggaccaatatcccaagaaaggaaggtggtttgggcccaatcaacattccattgttggctgacaccaaccactctttgtccagagactatggtgtcttgatcgaagaagaaggtgtcgccttgagaggtttgttcatcatcgacccaaagggtgtcattagacacatcaccattaacgatttgccagtcggtagaaacgttgacgaagccttgagattggttgaagccttccaatggaccgacaagaacggtactgtcttgccatgtaactggactccaggtgctgctaccatcaagccaaccgttgaagactccaaggaatacttcgaagctgccaacaaataa

SEQ ID NO: 708 - protein, 196 aa, Saccharomyces cerevisiae
MVAQVQKQAPTFKKTAVVDGVFDEVSLDKYKGKYVVLAFIPLAFTFVCPTEIIAFSEAAKKFEEQGAQVLFASTDSEYSLLAWTNIPRKEGGLGPINIPLLADTNHSLSRDYGVLIEEEGVALRGLFIIDPKGVIRHITINDLPVGRNVDEALRLVEAFQWTDKNGTVLPCNWTPGAATIKPTVEDSKEYFEAANK

SEQ ID NO: 709 - DNA, 686 bp, Saccharomyces cerevisiae
tggccactgaaaattcctggccagaccacccctgagctaagggagtttagccgctcaagcttttatttcctctgatgtaatatatcacacacccagacacggttgccaaggcctcgacggaaggccgcttcaagggacggggcagtggctatcagaaataccttaatatcatcaatatttttcatcaatcgcaaggtgtcaaacatcaataaaggatgatgctcaaaggtttatgcccgatgttcttctaatcccctttctctcctaaaataatcctttttttactcttcttcttttcccctgtttccatttttgtcttttctcaccccttatgggacatcaataatgcaagtatgtttatacatttttatataaatgtatatataaatgccatttcttacacataacctccattctttggttaattctttcttcattcttttttttttcattctgaaaagccctccaagcaagcacgctaatttaatatcgatttaaacatgaaagtatcacaagttttcatttctgccatctctgtcttcggcctcgctactagcgtaaatgctcaaaacgcatccaacaccacgagtaacgctgctcctgctttgcacgctcaaaatggtcaactactaaacgccggagtcgtcggtgctgctgttggtggtgctttggcctttttgatttag

SEQ ID NO: 710 - protein, 61 aa, Saccharomyces cerevisiae
MKVSQVFISAISVFGLATSVNAQNASNTTSNAAPALHAQNGQLLNAGVVGAAVGGALAFLI

SEQ ID NO: 711 - DNA, 992 bp, Saccharomyces cerevisiae
tgtccaaatatgttgatgaattctgtttgcaaagggggaacaacttcaatgaattgtatttggaaaggttgcagaatgttaccaaaacagatctgaaaaatgccatgcagaaatattttgtcaacatgtttgattccaataaaagcgttgcctttgtgagctgtcatccagctaaattggaatcagttcaagaattctttgaaactcaaggtttcactgtcgaaatagaagagctagaagatgacgatgacgaaattgatagtgaagaagacgaaaatgcgtgagtacatgacctccatttcagcttcactttcaacacagaaacagtgcgtattatctgcattcaataaatagcaaaaggagcattgtctcattcttttcgaattctgggattctgccttacggcgctctttcatttgattgatcgagaattattattatatttatatgagtacttgaaattcctcatatatttatttttagagtatttaagtagcttgatgaaaacattagataaaattactaattacgacctcttcgattttgcagatgagtttttgaaatttgttcctgtgtttagacctaatcccacggtaacttgtctttttggcaatccgttaactaatttactggttaacggtactggagcagcgtgtttttttgaattttgttccttggcattgataaaggtttcaaaaattctgcttgatctgttgctcttagcgctattaatcgattcagaaaacgaattgtgctttgaaattgatggagattggctatgcgtcctgggttttggcgaaggagacttggaagttggaagatctttaggtatggctcttccggatgatgatgttcttctttcaattaccttttggtttctttgcaacagttctttctctattttatttgtattcgaattaagaatttttttgagaacagtaaacaatttgctcgtggtttttttatcagtgctcaaaagaaatgacttgtaa

SEQ ID NO: 712 - protein, 163 aa, Saccharomyces cerevisiae
MKTLDKITNYDLFDFADEFLKFVPVFRPNPTVTCLFGNPLTNLLVNGTGAACFFEFCSLALIKVSKILLDLLLLALLIDSENELCFEIDGDWLCVLGFGEGDLEVGRSLGMALPDDDVLLSITFWFLCNSSFSILFVFELRIFLRTVNNLLVVFLSVLKRNDL

SEQ ID NO: 713 - DNA, 3746 bp, Saccharomyces cerevisiae
ttaacgatcgactcgacacattgttgatggaataattggtccctagttaaacagcggagaaatagccgcccaggataatcggagaaaagtcacgtgcaaaaagaaatcatattcgacgaaataaactagaataacttttgacgtttagcaataataaccccaaatggaagcgaacatttcccgatccttttagttttctttaaggcgctattggcattcatcttcaaagcttccgcaacacagaaattatatattcacatttctgaggcagagaatagttttgacaacgaaactgttaatatttttactccagttaccgcctttgaagtctgatattggtgtacaaaggtacttaggggtatttaagaacaagaaactacataaaatagttcgaaaagggaaaacaaaagtaacatcttgatgaaccgagaagccactaactagtttttaaaaagcaaaagaaattaaatctctccttttttttttttcatttcaaccaaatgtattttgataaggataattccatgagccctaggccgttattgccaagtgatgagcagaagctaaacattaatcttctaacgaaaaaggagaaattctcgcatttagacccccattatgacgcaaaagccactccacaaagaagcacttcgaatagaaacgttggcgatttacttttggaaaaaagaaccgctaagcctatgattcaaaaggccttgacgaatacggataatttcattgaaatgtaccataatcagcagagaaaaaatcttgatgatgacactattaaagaagtaatgattaatgatgaaaacggaaaaactgtcgctagtaccaacgacggcagatatgacaacgattacgataataacgatattaatgaccaaaaaactttggataatatagcgggaagtccccacatggaaaaaaatcgaaacaaagtaaagattgaacatgactcttcatctcaaaaaccaatagctaaagagtcatccaaagcccaaaaaaatataatcaaaaagggaatcaaggactttaaatttggtagtgtaataggtgatggcgcgtattctactgtaatgttagcgacgtcgattgataccaaaaagaggtacgccgcaaaagtactaaacaaagaatatttaatacgccagaagaaagtcaaatacgtcagcatagaaaaaaccgcccttcaaaagctcaataattctcctagtgttgtgcgattattttccacttttcaggatgaatcaagcctatactttctcttagagtatgcccccaatggggactttctttctttaatgaaaaaatacggttcattagacgaaacctgcgcacgatattatgctgcgcaaataatagatgccatagactacttacattccaacggtattattcatagagatataaaaccagaaaatattcttttagatggagaaatgaagatcaaactgactgattttggtactgcgaagttactgaatcctacaaataatagcgtttcgaaaccagaatacgatttatcaacaaggtcgaaatctttcgttggaactgcagaatacgtatctccagaacttttaaatgacagttttacagactatcgttgcgatatttgggccttcggatgtatacttttccagatgattgccggaaaaccaccattcaaagctaccaatgaatacttgactttccaaaaggtaatgaaagttcagtacgcctttacaccaggtttcccacttattatcagagatttggttaagaaaatcttagtaaaaaacttagaccgaagattgacgataagccaaattaaggaacatcattttttcaaagatttgaattttaaagacggctctgtttggtcaaaaacgcctccagagatcaaaccatataaaatcaacgccaaatccatgcaggcaatgccaagcggaagcgatagaaaactggtgaagaaatcagtcaacacacttggcaaatcgcatctagtgactcaaaggtcagcttcaagtccctctgttgaggaaactactcattcaaccctatacaataacaatactcacgcttctactgaaagtgaaatatcaataaagaagagacccactgatgaaagaacagcgcagatacttgaaaatgcaagaaagggtataaacaataggaaaaatcaaccaggcaagagaacaccaagtggtgcagcttctgctgccctagcagcttctgctgctttaaccaagaaaaccatgcaaagctatccaacttctagttcgaaaagtagcaggtcaagctctcctgcgacaacatcaagaccaggaacttataagcgtacttcttctacagaaagtaaaccatttgccaaatctccacctttgtcagcatcagttttatcgtcaaaagtcccaatgcctccatacacacctccaatgtcgccccctatgacaccatatgatacatatcaaatgacacctccctatacgacaaaacagcaggattattctgataccgcaattgccgcacctaagccttgtattagtaagcaaaatgttaaaaatagcacagattctcccttgatgaacaagcaagatattcaatggtccttttacctgaaaaacatcaacgaacatgtactaaggacggaaaaactggattttgttaccacaaattacgatatcttagagaagaaaatgcttaaactaaatggttcattgttagatcctcaactgtttggtaagcctagacatacttttttatcccaagtagctaggagtgggggagaggttacaggttttcgaaatgatccaactatgactgcttattccaaaacagaagatacgtactattcgaaaaatattatcgatttgcagctcttggaagatgattatcgaattgaaggaggtgacttatcggagttgcttactaacagaagcggagaagggtacaaatgcaatcaaaacagctcaccaatgaaagacgatgataaatccgaatctaacaataaaggaagctctgttttttctggcaagattaaaaaattatttcaccctacctcagcagctgaaacgctctcttcctctgatgaaaaaaccaagtactataaacgaaccattgtaatgacatcatttggaaggtttctagtatttgccaagaggaggcagccaaatccagttacaaatttaaagtatgaactagaatatgacataaatttgcgtcaacagggtaccaaaataaaagaactaatcattcccttggaaatgggaactaatcatatagttgtgattcagacaccttacaagtcatttcttttgagcactgataaaaaaaccacgagcaaattgtttactgttctcaaaaaaattcttaattcgaatacaaataaaatagagaaagaactgttgcaaagaaaccaaaaggtaattgaaagaagaacatcatcatccggaagagccatacctaaagatcttccaacttccaagtctccttcgccaaaacccaggacgcatagccaatctccatcaatttcaaagcacaattcgttttctgaatcgattaatagcgctaagagcaacagatcaagcagaatttttgaaacctttatcaatgccaaggaacaaaattcaaaaaaacacgctgctccagtaccgttaaccagtaaattagttaacggattgccaaaaagacaagttaccgtgggattaggtctaaacacaggaacaaatttcaaaaactcatctgcaaaatcgaagaggtcgtaa

SEQ ID NO: 714 - protein, 1081 aa, Saccharomyces cerevisiae
MYFDKDNSMSPRPLLPSDEQKLNINLLTKKEKFSHLDPHYDAKATPQRSTSNRNVGDLLLEKRTAKPMIQKALTNTDNFIEMYHNQQRKNLDDDTIKEVMINDENGKTVASTNDGRYDNDYDNNDINDQKTLDNIAGSPHMEKNRNKVKIEHDSSSQKPIAKESSKAQKNIIKKGIKDFKFGSVIGDGAYSTVMLATSIDTKKRYAAKVLNKEYLIRQKKVKYVSIEKTALQKLNNSPSVVRLFSTFQDESSLYFLLEYAPNGDFLSLMKKYGSLDETCARYYAAQIIDAIDYLHSNGIIHRDIKPENILLDGEMKIKLTDFGTAKLLNPTNNSVSKPEYDLSTRSKSFVGTAEYVSPELLNDSFTDYRCDIWAFGCILFQMIAGKPPFKATNEYLTFQKVMKVQYAFTPGFPLIIRDLVKKILVKNLDRRLTISQIKEHHFFKDLNFKDGSVWSKTPPEIKPYKINAKSMQAMPSGSDRKLVKKSVNTLGKSHLVTQRSASSPSVEETTHSTLYNNNTHASTESEISIKKRPTDERTAQILENARKGINNRKNQPGKRTPSGAASAALAASAALTKKTMQSYPTSSSKSSRSSSPATTSRPGTYKRTSSTESKPFAKSPPLSASVLSSKVPMPPYTPPMSPPMTPYDTYQMTPPYTTKQQDYSDTAIAAPKPCISKQNVKNSTDSPLMNKQDIQWSFYLKNINEHVLRTEKLDFVTTNYDILEKKMLKLNGSLLDPQLFGKPRHTFLSQVARSGGEVTGFRNDPTMTAYSKTEDTYYSKNIIDLQLLEDDYRIEGGDLSELLTNRSGEGYKCNQNSSPMKDDDKSESNNKGSSVFSGKIKKLFHPTSAAETLSSSDEKTKYYKRTIVMTSFGRFLVFAKRRQPNPVTNLKYELEYDINLRQQGTKIKELIIPLEMGTNHIVVIQTPYKSFLLSTDKKTTSKLFTVLKKILNSNTNKIEKELLQRNQKVIERRTSSSGRAIPKDLPTSKSPSPKPRTHSQSPSISKHNSFSESINSAKSNRSSRIFETFINAKEQNSKKHAAPVPLTSKLVNGLPKRQVTVGLGLNTGTNFKNSSAKSKRS

SEQ ID NO: 715 - DNA, 578 bp, Saccharomyces cerevisiae
gtgtatgatgtaatccatcacccccctataaaaacacctgtgcaccgcatatttccatagcgcgtgacgctaagtacaagaaacagcgaggggccgttaagtgcaggctttaccgagggcgccggctggcgcttcccgtggaagggtgtttgactcatcatcgcatcgcattacctcatgatgagtaaatagttgcgatttcacttatcacctctcgcggaaaaaaaaggcgatgacatgatatataaggctctctcgtaagacacttaactatccaacgttcattagattattcggtcaatttcttttttcatgcccctcctttttcttttcttttcttgactcgtcgtttctttttcttttttttttttttttttttcttcagaactataacacatagatacactcgaacatctaattgtttaaatactgcaaagaatacaaggtaatcgactcttctacataccctttttgcagatttgaaataaaaaaaacattatatgtttagcttatcgaactctcaatacacctgccaagactacatatctgaccacatctggaaaactagctcccactaa

SEQ ID NO: 716 - protein, 25 aa, Saccharomyces cerevisiae
MFSLSNSQYTCQDYISDHIWKTSSH

SEQ ID NO: 717 - DNA, 1344 bp, Candida albicans
atggctttgaacttggaagctgaccaagtcggggttgtgttgttcggttctgatagattagtcaaagaaggtgaaaccgtcaagagaactggtcaaattgtttccgttccaattggtccagaattgttaggtagagttgttgatggtttaggtaacccaattgatggtaaaggtccaatcaaggctgctgcttactccagagctcaagttaaagctccaggtattttaccaagaagatccgtccacgaaccaatgcaaaccggtttgaaatctgttgatgctttggttccaattggtagaggtcaaagagaattgatcattggtgatcgtcaaactggtaaaaccgccgttgccttggatgccatcttgaaccaaaagagatggaacaatggttctgacgaaaagaagaaattgtactgtgtttacgttgccgttggtcaaaagagatccactgttgctcaattggtccaaactttggaacaacacgacgctcttaaatactctgttattgttgctgctactgcttctgaagctgctccattgcaatacattgctccattcactgcttgtgctattggtgaatggttcagagacaatggtagacacgccttgattgtctacgatgatttgtccaaacaagctgttgcttaccgtcaattgtcattattgttgagaagaccaccaggtagagaagcttaccctggtgatgttttctacttacattccagattattggaaagagctgctaagatgtctgatgcttacggtggtggttctttgactgctttgccagttattgaaacccaaggtggtgatgtctctgcttatattccaactaacgttatttccattactgatggtcaaattttcttggaagctgaattattctacaaaggtatcagaccagctattaacgtcggtttgtccgtctcccgtgtcggttctgctgctcaagttaaagctatgaaacaagttgccggttccttgaaattgttcttggcccaatacagagaagttgctgctttcgctcaatttggttctgatttggatgcttctaccaaacaaaccttgaacagaggtgaaagattgacccaattattgaaacaaaaacaatacaacccattggctgccgaagaacaagttccattgattttcgctggtgttaacggtttcttggacaatgttgctcttgacagaattggtgaattcgaagaagctttcttgggtcacttgaaatctaacgaaactggtatcttggatgctattaagaccaagggtgaattatctaaagatgaattagaaaaattgagaaaagtcaccgaagaattcgttgcttctttctaa

SEQ ID NO: 718 - protein, 447 aa, Candida albicans
MALNLEADQVGVVLFGSDRLVKEGETVKRTGQIVSVPIGPELLGRVVDGLGNPIDGKGPIKAAAYSRAQVKAPGILPRRSVHEPMQTGLKSVDALVPIGRGQRELIIGDRQTGKTAVALDAILNQKRWNNGSDEKKKLYCVYVAVGQKRSTVAQLVQTLEQHDALKYSVIVAATASEAAPLQYIAPFTACAIGEWFRDNGRHALIVYDDLSKQAVAYRQLSLLLRRPPGREAYPGDVFYLHSRLLERAAKMSDAYGGGSLTALPVIETQGGDVSAYIPTNVISITDGQIFLEAELFYKGIRPAINVGLSVSRVGSAAQVKAMKQVAGSLKLFLAQYREVAAFAQFGSDLDASTKQTLNRGERLTQLLKQKQYNPLAAEEQVPLIFAGVNGFLDNVALDRIGEFEEAFLGHLKSNETGILDAIKTKGELSKDELEKLRKVTEEFVASF

SEQ ID NO: 719 - DNA, 2637 bp, Candida albicans
atggatgaacgatttttgaatccaccacctacagctgatcaagatgatactaatcagccacttgatgccatctttggtgatagagtcagaagatttcaagagtttttagatagaattgattctaatacaggtatagattacagatctattatcaaagatatgttgatcaagagtaagtttagattgagtgtttcaattgatgaaataagagagtttgacagagaattttggttggggttgctcaaccagccagctgactatttaccagcttgtgaaagagctttgagagacacagttttagctatttacgacccacaggatccaagtttcccacatgacagttatgaccctaaccagcaatactatttatcattcaagggagcatttgggggacattcgctcactcctagatcgattgattccagctatctttccaaaatggtttctattgaaggtattgtgactagagcttcattagttagaccaaaggttattagatcggttcattatgctgaaaaaactggtagattttatgcacgtgaataccgagaccaaacaacatcctttgatgcaattgctactccggctatatatccaactgaagatatggaaggtaataaattaaccacagagtatggttattcgacatacagagattaccagaagatctctgtacaagaaatgcctgaaacagctcctccaggtcaattgccaagatcggttgacgttattttggatgatgatttggtggatttgacaaaacccggtgatcgtgtacaaattgttggtgtttatcgtgccttaggaggtgctgcaaacaatagttcttctttcaaaacggttatcttaagtaattctgtttacttgttacatgccagatcaacaggggttgcttcacaagaaaagttaactgatcaagatattagaaatataaataaacttgcaaaggatagaaagatttttgatattttatcccgttctttggccccttcaatttatgggtttgactatattaagaaagctgttttacttatgatgatgggaggtgttgaaaaaaatttagataatggtacacatttgagaggtgacattaacattttgatggtgggtgacccatccactgccaaatctcaagtattacggtttgtgttgaacactgcttcattagctattgccactactggtagaggatcgtcaggtgtaggtttaacagctgctgttactaccgacaaggaaacaggagaaagaagattggaggctggtgcaatggtattggctgacagaggtattgtttgtattgatgaatttgataaaatgtcagatatcgaccgagtggccattcacgaagttatggaacaacaaactgtcactattgctaaagctggtattcacacctcattgaatgctcgttgttctgttattgctgccgcaaatccggtttttggacagtacgatgtccataaagatccacataaaaatattgccttgcccgattcattattgtctcgttttgatttgctctttgttgttacagatgatgtcaacccaacaagagacagggttatttctgagcatgttttaagaatgcacaggtttgttcctcctggattgatggagggagagccaatcagagaaaaatcagcagttacattggctgtcggagatgatgaaaccaatgaacaagaattattagaacagccaatgtttgaaaaatttaacacattattgcatgctggtattcaaaacaaaaagtcaaataatatactttcgattccattcttgaaaaaatatgtccagtacgccaagcaaagagtgcaaccagtgttgaccaagggtgcatccgactacattgttactacatattcctccttaagaaacgatttgataggcaacaaccaaagaaatacagctccaataactgctagaactttagaaactttgattcgtttagcaacagctcatgcaaaagtccgtttatccaaaactgttgatgtgaaagatgcaaaagttgccgaagagctattgagatatgcattattcaaggaagtagccaaaaagacaaaaaagagacaaaaaactacaagtatagtggactcagaagaggaggaagaggatgagtctgatgcagaaatggaaaattccgataacgaaataatgcccagagaaagtactagaagaaccagagctacagcacaaacacagcctccacaacagcaacaagcatctccttcactaacacccgaaccgccacttggacatcgggacgatggagatgacgatggagttggtgaagaattagaacaattccatttgtcatcatctcagcaacaacagcaacaacaatatttgcaaccattgactgagagatcatcaagtaacattgtatcatctaccgccacaaatgcaatcagcgttgagagattgaatattttcaaaagaatactagcccaggtgtcacgttctgcattatttgccaatgatcaagctgcggcaaactatcatgacgttactcgtgctatcaatgaacagatggaacaagaagatattttctcagagcaagagttgagtgctggatttgaagtgatgagttctgaaaacaagttttacctagaaagtgataagatttggaagatttaa

SEQ ID NO: 720 - protein, 878 aa, Candida albicans
MDERFLNPPPTADQDDTNQPLDAIFGDRVRRFQEFLDRIDSNTGIDYRSIIKDMLIKSKFRLSVSIDEIREFDREFWLGLLNQPADYLPACERALRDTVLAIYDPQDPSFPHDSYDPNQQYYLSFKGAFGGHSLTPRSIDSSYLSKMVSIEGIVTRASLVRPKVIRSVHYAEKTGRFYAREYRDQTTSFDAIATPAIYPTEDMEGNKLTTEYGYSTYRDYQKISVQEMPETAPPGQLPRSVDVILDDDLVDLTKPGDRVQIVGVYRALGGAANNSSSFKTVILSNSVYLLHARSTGVASQEKLTDQDIRNINKLAKDRKIFDILSRSLAPSIYGFDYIKKAVLLMMMGGVEKNLDNGTHLRGDINILMVGDPSTAKSQVLRFVLNTASLAIATTGRGSSGVGLTAAVTTDKETGERRLEAGAMVLADRGIVCIDEFDKMSDIDRVAIHEVMEQQTVTIAKAGIHTSLNARCSVIAAANPVFGQYDVHKDPHKNIALPDSLLSRFDLLFVVTDDVNPTRDRVISEHVLRMHRFVPPGLMEGEPIREKSAVTLAVGDDETNEQELLEQPMFEKFNTLLHAGIQNKKSNNILSIPFLKKYVQYAKQRVQPVLTKGASDYIVTTYSSLRNDLIGNNQRNTAPITARTLETLIRLATAHAKVRLSKTVDVKDAKVAEELLRYALFKEVAKKTKKRQKTTSIVDSEEEEEDESDAEMENSDNEIMPRESTRRTRATAQTQPPQQQQASPSLTPEPPLGHRDDGDDDGVGEELEQFHLSSSQQQQQQQYLQPLTERSSSNIVSSTATNAISVERLNIFKRILAQVSRSALFANDQAAANYHDVTRAINEQMEQEDIFSEQELSAGFEVMSSENKFYLESDKIWKI

SEQ ID NO: 721 - DNA, 1488 bp, Candida albicans
atgacaacaaaccctgctttggcggctgctcaagcatctcataataatattcctacaaagcaaatgaatcattcaacttcatcttcaaacggtaacggtagcaataattcatccgtggttggacttcactacaagattgggaaaaaaattggtgaaggttcttttggtgtcatttttgaaggtactaatataataaatggagtacccgtggccataaaatttgaacctagaaagactgaagctcctcaattacgagatgaatatagaacttataaacatttacaaggatgtgacggaattcctaatgcatattattttggtcaagaaggattacataatattttagtcattgatttattgggtccttctttagaagatttatttgattggtgtggtagaagatttagtgttaaaaccgtggtacaagttgctatacaaatgttgactttagtagaagaagttcatcgtcatgatttaatctatagagatatcaaacccgacaattttttaattggaagaagaggtgctactgatgaaaataatgttcatttgattgattttggtatggccaagcaatatcgtgatccaagaacaaagcaacatattccatatagagagaagaaatctttgagtgggacagctagatatatgagtattaacactcatttaggaagagaacaatcaagaagagatgatttagaagcattgggtcatgtatttttttatttccttagaggccaattaccttggcaaggtttaaaagctcccaccaataaacaaaagtatgagaaaattggtgataaaaagagaactacaccagcagttacattatgtgatggcttacctcaacaatttgctgaatatttagattcagttagatcattaccatttgatgctgaacctccatatgaagaatatagaatgttattattgtcagtgttggatgatttgggtcaagcttgtgatggagatatggattggatgcatcttaatggtggtagaggttgggatgctacaattaataaaaaacccaacttgcacggttatggacatcctaatccaccaaatgaacgtgaaagaagacatcgtgatcaaagaagaacaagacaacatcaacaactgcaacaagtacaacaacaacaattacaagctcaagctcaagcacaacaattacaacaattacaacaagcacaacaggcacaacaacaacaacaactgcaacaacatcaaccactatctgcagcccagttacatcaacaaaaattacagcatttggttaatcgaccattaccaccaattaaacaagaatcacaatcagcaatacaaagtggtaatggacatcatgaacttttgaataataatttaggtgatcagcatggaggaaaacatgaaggatacagttcacgaccagatcaatatcaacaacaacaaatggttgccgaagaagaagaaaacaaagggttctggtctaaattgtgttgtcattag

SEQ ID NO: 722 - protein, 495 aa, Candida albicans
MTTNPALAAAQASHNNIPTKQMNHSTSSSNGNGSNNSSVVGLHYKIGKKIGEGSFGVIFEGTNIINGVPVAIKFEPRKTEAPQLRDEYRTYKHLQGCDGIPNAYYFGQEGLHNILVIDLLGPSLEDLFDWCGRRFSVKTVVQVAIQMLTLVEEVHRHDLIYRDIKPDNFLIGRRGATDENNVHLIDFGMAKQYRDPRTKQHIPYREKKSLSGTARYMSINTHLGREQSRRDDLEALGHVFFYFLRGQLPWQGLKAPTNKQKYEKIGDKKRTTPAVTLCDGLPQQFAEYLDSVRSLPFDAEPPYEEYRMLLLSVLDDLGQACDGDMDWMHLNGGRGWDATINKKPNLHGYGHPNPPNERERRHRDQRRTRQHQQSQQVQQQQLQAQAQAQQLQQLQQAQQAQQQQQSQQHQPLSAAQLHQQKLQHLVNRPLPPIKQESQSAIQSGNGHHELLNNNLGDQHGGKHEGYSSRPDQYQQQQMVAEEEENKGFWSKLCCH

SEQ ID NO: 723 - DNA, 1362 bp, Candida albicans
atgttaagacggctctttccaatacgacaattgtacacaacaactagagccatggccagcaaatcaacagacccaactagtttgcataatccgtatttttatcaaaaaccggggcaaaaagatatctggtcgttaatcaacgaaactgcggcccaggcacaacaagaatccggcgagccaattgtcaatttgggacaagggtttttctcctacaatcctcctgagtttgcgattaacgctgttgaggaagcattgaccaagccgcaattcaaccaatatgcacatgctcgtggaaacccaaacttattgaaacaagtggcagagcactattcgcgatcgtatggacgtgctgtgggggttgacgaggtccaaatcaccacgggtgcaaatgagggaatgtttgccattttctttggtttcttgaccccgggcgatgaagtcattgtgtttgaaccattttttgaccaatacatccccaatgttgaaatgacaggagccaagatcaagtacgttgaaatcaagtatcccaagaaatttgacaacgaggttgtcacgggccaggattgggagattgactgggaaggattgaataatgccattaccgacaagaccaagatcatcgtgataaataccccacacaacccaatcggcaaagttttcaccgagaaggagttgtacaagattggcaagcttgccgtggaacacaatttaatccttgtcagcgacgaggtttacgagaacttgtattatactgacaagttccctcgtccagctgcattaccacagttgcctgaattggctgaaaggacgttgacagtgggttctgctgggaaatcatttgctgccactggttggagagtagggtatatccagggccctgccaatttgattaaatttgtaacagcggcccacaccagaatttgtttctcgaccccagcaccattgcaacaggcagtatctcaggggtttgagcaggctgagaaatcaaactattttgagaacactcgaaaggagtatgaacacaaatacaaaatattcaccaaggtatttgacgacttggggttaccctacaccgttgccgaaggagggtactttgtgttggtgaacttgctgaaagttaagatacccgcagattatgagtttcccggaaccatcagcgatagaggcactttagatttcaaattggcgtattggttgatcaaagaaattggggttgtgggaatccctccaacagagtttttaaccgaatcgaatagaaaggggaacggcttagaaaattgtgtcagatttgctgtttgcaaagatgattctgttttagaagacgcggttgagagattgaaaaaattaaaagactatttataa

SEQ ID NO: 724 - protein, 453 aa, Candida albicans
MLRRLFPIRQLYTTTRAMASKSTDPTSLHNPYFYQKPGQKDIWSLINETAAQAQQESGEPIVNLGQGFFSYNPPEFAINAVEEALTKPQFNQYAHARGNPNLLKQVAEHYSRSYGRAVGVDEVQITTGANEGMFAIFFGFLTPGDEVIVFEPFFDQYIPNVEMTGAKIKYVEIKYPKKFDNEVVTGQDWEIDWEGLNNAITDKTKIIVINTPHNPIGKVFTEKELYKIGKLAVEHNLILVSDEVYENLYYTDKFPRPAALPQLPELAERTLTVGSAGKSFAATGWRVGYIQGPANLIKFVTAAHTRICFSTPAPLQQAVSQGFEQAEKSNYFENTRKEYEHKYKIFTKVFDDLGLPYTVAEGGYFVLVNLSKVKIPADYEFPGTISDRGTLDFKLAYWLIKEIGVVGIPPTEFLTESNRKGNGLENCVRFAVCKDDSVLEDAVERLKKLKDYL

SEQ ID NO: 725 - DNA, 591 bp, Candida albicans
atggctccagtcgttcaacaaccagctccaagtttcaagaaaaccgccgtcgttgatggtgtctttgaagaagtcactttagaacaatacaaaggtaaatgggtcttgttggcctttattccattggccttcacattcgtctgcccatcagaaattattgcttattccgaagctgtaaagaaatttgccgaaaaggatgctcaagttttgtttgcctctactgactccgaatacacctggttggcttggaccaatgtcgccagaaaagacggtggtattggcaaagtcgacttcccagtcttggctgacaccaaccactccttgtccagagactacggtgtcttaattgaagaagaaggtgttgccttgagaggtattttcttgattgatccaaagggtgtcttgagacaaatcaccatcaatgacttgccagtcggtagatctgttgaagaatccttgagattgttggaggctttccaattcactgaaaaatacggtgaagtttgtccagctaactggcacccaggtgatgaaaccatcaagccaagcccagaagcatccaaggaatacttcaacaaagtcaacaaataa

SEQ ID NO: 726 - protein, 196 aa, Candida albicans
MAPVVQQPAPSFKKTAVVDGVFEEVTLEQYKGKWVLLAFIPLAFTFVCPSEIIAYSEAVKKFAEKDAQVLFASTDSEYTWLAWTNVARKDGGIGKVDFPVLADTNHSLSRDYGVLIEEEGVALRGIFLIDPKGVLRQITINDLPVGRSVEESLRLLEAFQFTEKYGEVCPANWHPGDETIKPSPEASKEYFNKVNK

SEQ ID NO: 727 - DNA, 2835 bp, Candida albicans
atgcataaatttagatattctttgcaccaacactatagcaaacgcaattcaagtgacaaatccaaagacagtccaattagccaaaacagcaatgaagaaaatgattcgactaaattaagttcaagtagtcttcaagacttacatgatgatctcgatgatatttataacaactatactttagcacagggtaccaataacaacagtgtagatacattggattctgaaaataatcaagctataaataagtttattgataaacctccagcaattcatggtatggaaccacaactaccggtgatgcacgtttcttcacgattatcttccttaggtaataccaccaatgaaaccggtgaaagcatcgccaaaagtgcaccaggaactccgttatcttcacattcatttgatttcagaccgcatcatcctcgtgcagtaacaaactcatccctcaatgtattgttagacacccctaatgtcagttccgaattcaatcatttagtggatcaaacaccacccaatgagtcggtagaaaggtttgacgacagtaataatactgtggacaatacagaagaggaagaaaataatgatgatacagacgaaataccaaaatccgaaacattgaaacaaaacgaggagaattgggaaaaaaagggtgctgcagttaaaactatcaagactatggatggagaaatgaaaactattcggcgaaatgttactgatttcaaatttggtaaagaattgggtgaaggttcatattccacggtgattttagccactgataagattactggtaaacaatatgctgtaaaagtacttgataagcgacatattataaaagaaaagaaagtcaagtatgtcaatatagaaaaacatgcattgaatcgattaagtaatagattaggggttatttcattatatttcaccttccaggataaagattcgctttattttgttttggattatgcttcaaatggtgaattattgacattgatcaagagatacaatactttaaatgaggaatgtactagacattttggtgcacaaatattagatgctattaaatatatgcatgataatggtgttatacatcgagacctaaaaccagagaatatattattagatgacaaaatgagaattcaaattacagattttggtactgcaagattattagagaaaaagaatgatgaaagtgaagaatacccagtggatgtaagagcaaaatcatttgttggaaccgctgaatatgtatcccctgaattattagaaaataagtattgtggtaaacctggagatgtttgggcttttggttgcatcatatatcaaatgattgctgggaaaccaccatttaaggcaactaatgaatatttaacgtttcaaaaaattacgaaattgcaatttgcgtttagtgcaggattccctacaattattagagatttaataaagaagattcttgtgttgcaaccttcacgacgtgccaccattccagaaatacaaaaacattactttttccaatcggtcgactttaaagattttgatctgatttggttgtctgatcctcctgaaataggaccttataaaatgacagcaaaatccatgatgaaagtaccggaattgaataaggcacctataaccacagtcattaagaagaatgtgaagaaatccacaaactcaaattcaaataccaacaatgtcgccactgctgttggtggtagtagtagtaacggacataaagggtcatcaccgactcctgagaaagagccgagcccagctactattaataacaagtccacagaaaaagttagtgccgctagtgtagctgcatatgttttaaacaaaccagctacaaaccaaaattccagtacatccgaggattcatctaagcgtagcagcaactccaatgaaactcgcaaactttcatattcacaacaggattatattccgggaacaaatattttacgtccacagattagtactagaccgtcagtaggatcttatgtgaaaaccacaccatcaaaggatagaaaaacattaaccaaggtcccactgaatatccatcaacaacaagaaaaagtgaaaccgaaagtaatggaagtgaagccagcaactacattggaagcagcatgggaaccatatttaacccatccagatgaaagaatacttcgtattggtccagttattgctcataaagaaccaacagaaccatttgaaaagaagaataaagcatctttacatatatcacctttggatataaataaagaacaaagaagtagatccaatactagtttacttacacaaattgtaaatgaagtaaacaataacaccagcgaattgaaaaaagtggaaaatgctgatgaatcacttgccattattgaaccacaatataatatgaagagaagtccaacttctgatagtaagaaaagtatggatattgaaagatctgcatctacttctggaagtagaattagtaagaaggcaattttcaaaaaattggggtttagtcatttagaaaaaaatgatagtgaagaatcaaatggtcctagtttaacggaaaaaccacaaacttgtacattggttgttacaactcatggtcgagcattacttttcattagaaatgatatagaatccaattatcttttaattgctgaaatcaaattgaaatatccatttattcatttccaagaattagttatatcacaaactaaattttctaaattagtaccatcagtcggagtatttgtcattagttcaattgataattcattaatttttgaagtagaaaaatttgaagtgaatcaatggactgaagcattagctaaatctaaatataatgaaatataa

SEQ ID NO: 728 - protein, 944 aa, Candida albicans
MHKFRYSLHQHYSKRNSSDKSKDSPISQNSNEENDSTKLSSSSLQDLHDDLDDIYNNYTLAQGTNNNSVDTLDSENNQAINKFIDKPPAIHGMEPQLPVMHVSSRLSSLGNTTNETGESIAKSAPGTPLSSHSFDFRPHHPRAVTNSSLNVLLDTPNVSSEFNHLVDQTPPNESVERFDDSNNTVDNTEEEENNDDTDEIPKSETLKQNEENWEKKGAAVKTIKTMDGEMKTIRRNVTDFKFGKELGEGSYSTVILATDKITGKQYAVKVLDKRHIIKEKKVKYVNIEKHALNRLSNRLGVISLYFTFQDKDSLYFVLDYASNGELLTLIKRYNTLNEECTRHFGAQILDAIKYMHDNGVIHRDLKPENILLDDKMRIQITDFGTARLLEKKNDESEEYPVDVRAKSFVGTAEYVSPELLENKYCGKPGDVWAFGCIIYQMIAGKPPFKATNEYLTFQKITKLQFAFSAGFPTIIRDLIKKILVLQPSRRATIPEIQKHYFFQSVDFKDFDSIWLSDPPEIGPYKMTAKSMMKVPELNKAPITTVIKKNVKKSTNSNSNTNNVATAVGGSSSNGHKGSSPTPEKEPSPATINNKSTEKVSAASVAAYVLNKPATNQNSSTSEDSSKRSSNSNETRKLSYSQQDYIPGTNILRPQISTRPSVGSYVKTTPSKDRKTLTKVPSNIHQQQEKVKPKVMEVKPATTLEAAWEPYLTHPDERILRIGPVIAHKEPTEPFEKKNKASLHISPLDINKEQRSRSNTSLLTQIVNEVNNNTSELKKVENADESLAIIEPQYNMKRSPTSDSKKSMDIERSASTSGSRISKKAIFKKLGFSHLEKNDSEESNGPSLTEKPQTCTLVVTTHGRALLFIRNDIESNYLLIAEIKLKYPFIHFQELVISQTKFSKLVPSVGVFVISSIDNSLIFEVEKFEVNQWTEALAKSKYNEI

SEQ ID NO: 729 - DNA, 288 bp, Candida albicans
atggcaggtgcaccacatccacatacttatatgggctggtggggtagtttaggctccccaaagcaaaaatatattactcaatatactatttctccatatgctgctaaaccattaaagggggctgcttataatgctgttttcaatacttttagaagaaccaagaatcaatttctttatgttgccattccatttgttgttgtttggagtatttggactagagctagagattataatgaatacttgtacactaaagaaggtagagaagaattggaaagagttaatgtttaa

SEQ ID NO: 730 - protein, 95 aa, Candida albicans
MAGAPHPHTYMGWWGSLGSPKQKYITQYTISPYAAKPLKGAAYNAVFNTFRRTKNQFLYVAIPFVVVWSIWTRARDYNEYLYTKEGREELERVNV

SEQ ID NO: 731 - DNA, 252 bp, Candida albicans
atgccagtcgatccagctacttttaaattcgaaactccacaatttgacccaagattcccaaaccaaaaccaatccaaacattgtgctcaagcctacgttgattaccacaaatgtgtcaatgtgaaaggtgaagaatttgaaccatgcaaaatctttttcaaaactttcacttcattatgtcctttggattgggtcgaaaaatgggatgatcaaagagctgctggtaaattcccagtcaacatggacgcttag

SEQ ID NO: 732 - protein, 83 aa, Candida albicans
MPVDPATFKFETPQFDPRFPNQNQSKHCAQAYVDYHKCVNVKGEEFEPCKIFFKTFTSLCPLDWVEKWDDQRAAGKFPVNMDA

What is claimed is:

1. An isolated nucleic acid consisting of a synthetic BAX-gene comprising the sequence set forth in SEQ ID NO 1, or a sequence set forth in SEQ ID NO 1 which is fused to a carrier gene.

2. An isolated nucleic acid according to claim 1 selected from the group consisting of DNA, cDNA, genomic DNA, synthetic DNA, and RNA wherein T is replaced by U.

3. An isolated nucleic acid according to claim 1 wherein the carrier gene is the yeast GFP gene.

4. A vector comprising a nucleic acid as defined in claim 1.

5. A vector according to claim 4 which is an expression vector wherein said nucleic acid is operably linked to one or more control sequences allowing expression in prokaryotic and/or eukaryotic host cells.

6. An expression vector according to claim 5 which comprises an inducible promoter.

7. An expression vector according to claim 5 which comprises a sequence encoding a reporter molecule.

8. A vector according to claim 4, wherein said vector induces programmed cell death in *Candida* species.

9. A host cell transformed, transfected or infected with a vector according to claim 4.

10. A host cell of claim 9 selected from the group consisting of a bacterial, yeast or fungal cell.

11. A host cell according to claim 9 wherein said cell is a *Candida* species cell.

12. A genetically modified yeast or fungal cell according to claim 10 wherein said modification results in an onset of at least one pathway eventually leading to programmed cell death.

13. A genetically modified *Candida* species cell according to claim 11 wherein said modification results in an onset of at least one pathway eventually leading to programmed cell death.

* * * * *